(12) United States Patent
Jones

(10) Patent No.: US 9,090,892 B2
(45) Date of Patent: Jul. 28, 2015

(54) PLANT CHIMERIC BINDING POLYPEPTIDES FOR UNIVERSAL MOLECULAR RECOGNITION

(71) Applicant: Monsanto Technology LLC, St. Louis, MO (US)

(72) Inventor: Jennifer Jones, Kirkwood, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 13/845,984

(22) Filed: Mar. 18, 2013

(65) Prior Publication Data

US 2013/0203633 A1    Aug. 8, 2013

Related U.S. Application Data

(62) Division of application No. 13/093,518, filed on Apr. 25, 2011, now Pat. No. 8,399,385, which is a division of application No. 11/706,847, filed on Feb. 13, 2007, now Pat. No. 7,951,753.

(60) Provisional application No. 60/773,086, filed on Feb. 13, 2006.

(51) Int. Cl.
    *C12N 15/09* (2006.01)
    *C12N 15/10* (2006.01)
    *C07K 14/415* (2006.01)
    *C12N 9/16* (2006.01)

(52) U.S. Cl.
    CPC .......... *C12N 15/1068* (2013.01); *C07K 14/415* (2013.01); *C12N 9/16* (2013.01); *C12N 15/1044* (2013.01)

(58) Field of Classification Search
    CPC .................................................. C12N 15/1068
    See application file for complete search history.

(56) References Cited

U.S. PATENT DOCUMENTS

| | | | |
|---|---|---|---|
| 5,283,317 | A | 2/1994 | Saifer et al. |
| 5,977,435 | A | 11/1999 | Lefebvre et al. |
| 6,521,453 | B1 | 2/2003 | Crameri et al. |
| 6,589,741 | B2 | 7/2003 | Pluckthun et al. |
| 2004/0034888 | A1 | 2/2004 | Liu et al. |
| 2004/0123343 | A1* | 6/2004 | La Rosa et al. ............... 800/278 |
| 2004/0132028 | A1 | 7/2004 | Stumpp et al. |
| 2004/0266993 | A1 | 12/2004 | Evans |
| 2005/0053989 | A1 | 3/2005 | Sharon et al. |
| 2006/0240537 | A1 | 10/2006 | Wang et al. |

FOREIGN PATENT DOCUMENTS

| | | | |
|---|---|---|---|
| JP | 2002-315582 | * 10/2002 | ............. C12N 15/09 |
| WO | 94/10300 A1 | 5/1994 | |
| WO | 02/20565 A2 | 3/2002 | |
| WO | WO 2005/030967 | * 4/2005 | ............. C12N 15/82 |
| WO | 2006/110508 A2 | 10/2006 | |

OTHER PUBLICATIONS

Abe et al., "Molecular Cloning of a Cysteine Proteinase Inhibitor of Rice (Oryzacystatin)" J. Biol. Chen:. 262 (35):16793-16797 (1987).
Bartel et al., "Elimination of False Positives That Arise in Using the Two-Hybrid System" Biotechniques 14(6):920-924 (1993).
Colas et al., "Genetic selection of peptide aptamers that recognize and inhibit cyclin-dependent kinase 2" Nature 380:548-550 (1996).
Gyuris et al., "Cdil, a Human GI and S Phase Protein Phosphatase That Associates with Cdk2" Cell 75:791-803 (1993).
Hubsman et al., "A novel approach for the identification of protein-protein interaction with integral membrane proteins" Nucl. Acids Res. 29(4):E18:1-6 (2001).
Iwabuchi et al. "Use of the two-hybrid system to identify the domain of p53 involved in oligomerization" Oncogene 8:1693-1696 (1993).
Kim et al., "Rice C2-Domain Proteins Are Induced and Translocated to the Plasma Membrane in Response to a Fungal Elicitor" Biochemistry 42:11625-11633 (2003).
Madura et at' N-recognin/Ubc2 Interactions in the N-end Rule Pathway J. Biol. Chem. 268:12046-12054 (1993).
Nagata et ca, "Three-Dimensional Solution Structure of Oryzacystaxin-I, a Cysteine Proteinase Inhibitor of the Rice, *Oryza sativa* L. *japonica*" Biochemistry 39:14753-14760 (2000).
Nakamura et at., "Codon usage tabulated from international DNA sequence databases: status for the year 2000" Nucl. Acids Res. 28:292 (2000).
Nygren et at.. "Binding Proteins from Alternative Scaffolds," J. of Immun. Methods 290:3-28 (2004).
Straeter et at, "Crystal Structure of a Purple Acid Phosphatase Containing a Dinuclear Fe(III)-Zn(II) Active Site" Science 268(5216):1489-1492 (1995).
Voiles et al., "A computer program for the estimation of protein and nucleic acid sequence diversity in random point mutagenesis libraries" 33(11):3667-3677 (2005).
Willats, "Phage display: practicalities and prospects" Plant MoL Biol. 50:837-854 (2002).
Wu et al., "Random mutagenesis in the large extrinsic loop E and transmembrane a-helix VI of the CP 47 protein of Photosystem II" Plant MoL BioL 39(2):381-386 (1999).
Zervos et al., "Mxil, a Protein That Specifically Interacts with Max to Bind Myc-Max Recognition Sites" Cell 72:223-232 (1993).
International Search Report and Written Opinion dated May 20, 2008, see note in Office action.
Hosse ralf J.et al., "A new generation of protein display scaffolds for molecular recognition", Protein Science, (2006) 15:14-27.

(Continued)

*Primary Examiner* — Amber D Steele
(74) *Attorney, Agent, or Firm* — Thompson Coburn LLP; J. Wendy Davis

(57) ABSTRACT

Libraries of nucleic acids encoding chimeric binding polypeptides based on plant scaffold polypeptide sequences. Also described are methods for generating the libraries.

8 Claims, 36 Drawing Sheets

(56) References Cited

OTHER PUBLICATIONS

Geert De Jaeger et al.,"The plantibody approach: expression of antibody genes in plants to modulate plant metabolism or to obtain pathogen resistance", Plant Molecular Biology, 43:419-428 (2000).

Binz et al., 2003, J. Mol. Biol., Designing Repeat Proteins: Well-Expressed, Soluble, and Stable Proteins from Combinatorial Libraries of Consensus Ankyrin Repeat Proteins, 332:489-503.

Kohl et al., PNAS, Designed to be stable: Crystal structure of a consensus ankyrin repeat protein, 100(4):1700-1705, date: 2003.

Flanagan et al., "Identification and Molecular Modeling of a Novel, Plant-Like, Human Purple Acid Phosphate", Gene, 2006, pp. 12-20, vol. 377.

Vogel et al., "Heterologous Expression and Characterization of Recombinant Purple Acid Phosphatase from Red Kidney Bean", 2002, pp. 164-172, Archives of Biochemistry and Biophysics, vol. 401.

Zimmermann et al., Differential Expression of Three Purple Acid Phosphatases from Potato, Plant Biology, 2004, pp. 519-528, vol. 6.

* cited by examiner

PLANT CHIMERIC BINDING POLYPEPTIDES FOR UNIVERSAL MOLECULAR RECOGNITION

This application is a divisional of co-pending U.S. application Ser. No. 13/093,518, filed Apr. 25, 2011, which is a divisional of U.S. application Ser. No. 11/706,847, filed Feb. 13, 2007, now U.S. Pat. No. 7,951,753, which claims the benefit of U.S. provisional application Ser. No. 60/773,086, filed Feb. 13, 2006. The entire contents of each of these priority applications are considered part of the present application and are hereby incorporated in the present application in their entirety.

BACKGROUND

The binding specificity and affinity of a protein for a target are determined primarily by the protein's amino acid sequence within one or more binding regions. Accordingly, varying the amino acid sequence of the relevant regions reconfigures the protein's binding properties.

In nature, combinatorial changes in protein binding are best illustrated by the vast array of immunoglobulins produced by the immune system. Each immunoglobulin includes a set of short, virtually unique, amino acid sequences known as hypervariable regions (i.e., protein binding domains), and another set of longer, invariant sequences known as constant regions. The constant regions form β sheets that stabilize the three dimensional structure of the protein in spite of the enormous sequence diversity among hypervariable regions in the population of immunoglobulins. Each set of hypervariable regions confers binding specificity and affinity. The assembly of two heavy chain and two light chain immunoglobulins into a large protein complex (i.e., an antibody) further increases the number of combinations with diverse binding activities.

The binding diversity of antibodies has been successfully exploited in many biomedical and industrial applications. For example, libraries have been constructed that express immunoglobulins bearing artificially diversified hypervariable regions. Immunoglobulin expression libraries are very useful for identifying high affinity antibodies to a target molecule (e.g., a receptor or receptor ligand). A nucleic acid encoding the identified immunoglobulin can then be isolated and expressed in host cells or organisms.

However, despite the usefulness of immunoglobulins and antibodies in general, their expression in transgenic plants can be problematic. Immunoglobulins may not fold properly in plant cytoplasm because they require the formation of multiple disulfide bonds. Further, the large size of immunoglobulins prevents their effective uptake by some plant pests. Thus, immunoglobulins are frequently not useful as protein pesticides or pesticide targeting molecules. Finally, expressing mammalian proteins such as immunoglobulins (e.g., as so called "plantibodies") in edible plants also raises potential issues of consumer acceptance and is thus an impediment to commercialization. This may effectively prevent use of plantibodies for many input and output traits in transgenic plants.

The above-mentioned disadvantages of immunoglobulins can be circumvented by generating diverse libraries of binding proteins from other classes of structurally tolerant proteins, preferably plant-derived proteins. These libraries can be screened to identify individual proteins that bind with desired specificity and affinity to a target of interest. Afterwards, identified binding proteins can be efficiently expressed in transgenic plants.

SUMMARY

Diverse libraries of nucleic acids encoding plant chimeric binding polypeptides, as well as methods for generating them are described herein. The chimeric binding polypeptides are conceptually analogous to immunoglobulins in that they feature highly varied binding domains in the framework of unvarying sequences that encode a structurally robust protein. However, the chimeric binding polypeptides described herein have the considerable advantage of being derived from plant protein sequences thereby avoiding many of the problems associated with immunoglobulin expression in plants. The amino acid sequences of the encoded plant chimeric binding proteins are derived from a scaffold polypeptide sequence that includes subsequences to be varied. The varied subsequences correspond to putative binding domains of the plant chimeric binding polypeptides, and are highly heterogeneous in the library of encoded plant chimeric binding proteins. In contrast the sequence of the encoded chimeric binding proteins outside of the varied subsequences is essentially the same as the parent scaffold polypeptide sequence and highly homogeneous throughout the library of encoded plant chimeric binding proteins. Such libraries can serve as a universal molecular recognition platform to select proteins with high selectivity and affinity binding for expression in transgenic plants.

Accordingly, one aspect described herein is a library of nucleic acid molecules encoding at least ten (e.g., at least 1,000, $10^5$, or $10^6$) different chimeric binding polypeptides. The amino acid sequence of each polypeptide includes $C_1$-$X_1$-$C_2$-$X_2$-$C_3$-$X_3$-$C_4$, where $C_1$-$C_4$ are backbone subsequences selected from purple acid phosphatase (i.e., SEQ ID NOs: 1-30, 31-60, 61-90, and 91-120, respectively) that can include up to 30 (e.g., 20, 10, or 5) single amino acid substitutions, deletions, insertion, or additions to the selected purple acid phosphatase sequences. The $C_1$-$C_4$ subsequences are homogeneous across many of the polypeptides encoded in the library. In contrast to the $C_1$-$C_4$ backbone subsequences, the $X_1$-$X_3$ subsequences are independent variable subsequences consisting of 2-20 amino acids, and these subsequences are heterogeneous across many of the polypeptides in the library. For example, the library of chimeric polypeptides can have the amino acid sequence of any one of SEQ ID NOs:124-126 including one to ten single amino acid substitutions, deletions, insertions, or additions to amino acid positions corresponding to 23-39, 51-49, and 79-84 of SEQ ID NOs:124-126.

Another aspect described herein is a method for generating the just-described library. The method includes providing a parental nucleic acid encoding a plant scaffold polypeptide sequence containing $C_1$-$X_1$-$C_2$-$X_2$-$C_3$-$X_3$-$C_4$ as defined above. The method further includes replicating the parental nucleic acid (e.g., at least one of the $X_1$-$X_3$ subsequences is selected from SEQ ID NOs: 121-123) under conditions that introduce up to 10 single amino acid substitutions, deletions, insertions, or additions to the parental $X_1$, $X_2$, or $X_3$ subsequences, whereby a heterogeneous population of randomly varied subsequences encoding $X_1$, $X_2$, or $X_3$ is generated. The population varied subsequences is then substituted into a population of parental nucleic acids at the positions corresponding to those encoding $X_1$, $X_2$, or $X_3$. The amino acid substitutions, deletions, insertions or additions can be introduced into the parental nucleic acid subsequences by replication in vitro (e.g., using a purified mutagenic polymerase or nucleotide analogs) or in vivo (e.g., in a mutagenic strain of *E. coli*). The just-described library can be introduced into a biological replication system (e.g., *E. coli* or bacteriophage) and amplified.

A related aspect described herein is another method for generating the above-described library of nucleic acids. The method includes selecting an amino acid sequence containing $C_1$-$X_1$-$C_2$-$X_2$-$C_3$-$X_3$-$C_4$ as defined above. The method further includes providing a first and second set of oligonucleotides having overlapping complementary sequences. Oligonucleotides of the first set encode the $C_1$-$C_4$ subsequences and multiple heterogeneous $X_1$-$X_3$ subsequences. Oligonucleotides of the second set are complementary to nucleotide sequences encoding the C1-C4 subsequences and multiple heterogeneous $X_1$-$X_3$ subsequences. The two sets of oligonucleotides are combined to form a first mixture and incubated under conditions that allow hybridization of the overlapping complementary sequences. The resulting hybridized sequences are then extended to form a second mixture containing the above-described library.

Yet another aspect of the invention is a library of nucleic acids encoding chimeric binding polypeptides each of which include an amino acid sequence at least 70% (i.e., any percentage between 70% and 100%) identical to any of SEQ ID NOs: 127-129. The amino acid sequence of each of the encoded polypeptides includes amino acids that differ from those of SEQ ID NOs: 127-129 at positions 14, 15, 33, 35-36, 38, 47-48, 66, 68-69, 71, 80, 81, 99, 101-102, and 104, and the amino acid differences are heterogeneous across a plurality of the encoded polypeptides. The amino acid sequence of each of the encoded polypeptides outside of the above-listed positions is homogeneous across a plurality of the encoded chimeric polypeptides.

A related aspect described herein is a method for generating the just-described library. The method includes selecting an amino acid sequence corresponding to any of SEQ ID NOs: 127-129, in which the selected sequence differs from SEQ ID NOs:127-129 in at least one the above-mentioned positions. The method further includes providing a first and second set of oligonucleotides having overlapping complementary sequences. Oligonucleotides of the first set encode subsequences of the selected amino acid sequence, the subsequences being heterogeneous at the above-mentioned positions. Oligonucleotides of the second set are complementary to nucleotide sequences encoding subsequences of the selected amino acid sequence, the subsequences being heterogeneous at the above-mentioned positions. The two sets of oligonucleotides are combined to form a first mixture and incubated under conditions that allow hybridization of the overlapping complementary sequences. The resulting hybridized sequences are then extended to form a second mixture containing the above-described library.

Various implementations of the invention can include one or more of the following. For example, each nucleic acid in a library can include a vector sequence. Also featured is any nucleic acid isolated from one of the above-described libraries, as well as the chimeric binding polypeptide encoded by it, in pure form.

In one implementation, a population of cells (or individual cells selected from the population of cells) is provided which express chimeric binding polypeptides encoded by one of the libraries. Another implementation features a library of purified chimeric binding polypeptides encoded by one the nucleic acid libraries. Yet another implementation provides a population of filamentous phage displaying the chimeric binding polypeptides encoded by one of the nucleic acid libraries.

In various implementations of methods for generating the above described nucleic acid libraries by oligonucleotide assembly, one or more of the following can be included. For example, the method can further include, after the second mixture that contains the nucleic acid library is generated, performing a cycle of denaturing the population of nucleic acids followed by a hybridization and an elongation step. Optionally, this cycle can be repeated (e.g., up to 100 times). The nucleic acid libraries can be amplified by a polymerase chain reaction that includes a forward and a reverse primer that hybridize to the 5' and 3' end sequences, respectively, of all nucleic acids in the library. In one implementation, amino acids to be encoded in variable sequence positions are selected from a subset (e.g., only 4, 6, 8, 10, 12, 14 or 16) of alanine, arginine, asparagine, aspartate, glutamine, glutamate, glycine, histidine, isoleucine, leucine, lysine, methionine, phenylalanine, proline, serine, threonine, tryptophan, tyrosine, cysteine and valine (the 20 naturally occurring amino acids). In other cases 19 of the 20 are used (excludes cysteine). In other cases all 20 are used. In another implementation, the subset of amino acids includes at least one aliphatic, one acidic, one neutral, and one aromatic amino acid (e.g., alanine, aspartate, serine, and tyrosine).

Described herein is library of nucleic acids encoding at least ten different polypeptides, the amino acid sequence of each polypeptide comprising:

C1-X1-C2-X2-C3-X3-C4, wherein: (i) subsequence C1 is selected from SEQ. ID NOs:1-30, subsequence C2 is selected from SEQ ID NOs:31-60, subsequence C3 is selected from SEQ. ID NOs:61-90; subsequence C4 is selected from SEQ. ID NOs:91-120, and each of C1-C4 comprise up to 10 single amino acid substitutions, deletions, insertions, or additions to the selected subsequence; (ii) C1-C4 are homogeneous across a plurality of the encoded polypeptides; (iii) each of X1-X3 is an independently variable subsequence consisting of 2-20 amino acids; and each of X1-X3 are heterogeneous across a plurality of the encoded polypeptides.

Also described is a library of nucleic acids encoding at least ten different polypeptides, the amino acid sequence of each polypeptide comprising:

C1-X1-C2-X2-C3-X3-C4, wherein: (i) subsequence C1 is selected from FIG. 2 or FIG. 4, subsequence C2 is selected from FIG. 2 or FIG. 4, subsequence C3 is selected from FIG. 2 or FIG. 4; subsequence C4 is selected from FIG. 2 or FIG. 4, and each of C1-C4 comprise up to 10 single amino acid substitutions, deletions, insertions, or additions to the selected subsequence; (ii) C1-C4 are homogeneous across a plurality of the encoded polypeptides (iii) each of X1-X3 is an independently variable subsequence consisting of 2-20 amino acids; and each of X1-X3 are heterogeneous across a plurality of the encoded polypeptides.

Also described is a library of nucleic acids encoding at least ten different polypeptides, the amino acid sequence of each polypeptide comprising:

C1-X1-C2-X2-C3-X3-C4, wherein (i) subsequence C1 is selected from FIG. 3 or FIG. 5, subsequence C2 is selected from FIG. 3 or FIG. 5, subsequence C3 is selected from FIG. 3 or FIG. 5; subsequence C4 is selected from FIG. 3 XX, and each of C1-C4 comprise up to 30 single amino acid substitutions, deletions, insertions, or additions to the selected subsequence; (ii) C1-C4 are homogeneous across a plurality of the encoded polypeptides (iii) each of X1-X3 is an independently variable subsequence consisting of 2-20 amino acids; and each of X1-X3 are heterogeneous across a plurality of the encoded polypeptides.

In various embodiments: at least 1,000 different polypeptides are encoded; at least 100,000 different polypeptides are encoded; at least 1,000,000 different polypeptides are encoded; each of C1-C4 independently comprises up to 20 single amino acid substitutions, deletions, insertions, or additions to the selected subsequence; each of C1-C4 independently comprises up to 10 single amino acid substitutions, deletions, insertions, or additions to the selected subsequence; each of C1-C4 independently comprises up to 5 single amino acid substitutions, deletions, insertions, or additions to the selected subsequence; none of C1-C4 comprise amino acid substitutions, deletions, insertions, or additions to the selected subsequence; amino acids of X1-X3 are selected from fewer than 20 amino acids genetically encoded in plants; amino acids of X1-X3 are selected from all 20 amino acids genetically encoded in plants; the fewer than 20 genetically encoded amino acids include at least one aliphatic amino acid, at least one acidic amino acid, at least one neutral amino acid, and at least one aromatic amino acid; fewer than 20 genetically encoded amino acids comprise alanine, aspartate, serine, and tyrosine.

In some cases: the amino acid sequence of each polypeptide is selected from:

(a). a polypeptide comprising C1-X1-C2-X2-C3-X3-C4 wherein C1=SEQ. ID NO:1, C2=SEQ. ID NO: 31, C3=SEQ. ID NO: 61, and C4=SEQ. ID NO: 91;

(b). a polypeptide comprising C1-X1-C2-X2-C3-X3-C4 wherein C1=SEQ. ID NO:2, C2=SEQ. ID NO: 32, C3=SEQ. ID NO: 62, and C4=SEQ. ID NO: 92; and (c). a polypeptide comprising C1-X1-C2-X2-C3-X3-C4 wherein C1=SEQ. ID NO:3, C2=SEQ. ID NO: 33, C3=SEQ. ID NO: 63, and C4=SEQ. ID NO: 93.

In some cases: each encoded polypeptide comprises C1-X1-C2-X2-C3-X3-C4, wherein C1=SEQ. ID NO: X1, C2=SEQ. ID NO: X2, C3=SEQ. ID NO: X3, and C4=SEQ. ID NO: X4; designated SEQ. ID NO: 130.

In some cases: each encoded polypeptide comprises C1-X1-C2-X2-C3-X3-C4, wherein C1=SEQ. ID NO: X1, C2=SEQ. ID NO: X2, C3=SEQ. ID NO: X3, and C4=SEQ. ID NO: X4; designated SEQ. ID NO: 130.

In some embodiments: wherein each of the nucleic acids comprises a vector sequence.

Also described: are an isolated nucleic acid selected from the library and a isolated cell expressing the nucleic acid as well as a purified library of purified polypeptides encoded by the library; and a population of filamentous phage displaying the polypeptides encoded by the library.

Described herein is a method of generating a library, comprising: (i) providing a parental nucleic acid encoding a parental polypeptide comprising the amino acid sequence: C1-X1-C2-X2-C3-X3-C4, wherein subsequence C1 is selected from SEQ ID NOs:1-30, subsequence C2 is selected from SEQ ID NOs:31-60, subsequence C3 is selected from SEQ ID NOs:61-90; subsequence C4 is selected from SEQ ID NOs:91 120; each of C1-C4 comprises up to 10 single amino acid substitutions, deletions, insertions, or additions to the selected subsequence; and each of X1-X3 is an independent subsequence consisting of 2-20 amino acids; (ii) replicating the parental nucleic acid under conditions that introduce up to 10 single amino acid substitutions, deletions, insertions, or additions to the X1, X2, or X3 subsequences, whereby a population of randomly varied subsequences encoding X1', X2', or X3' is generated; and (iii) the population of randomly varied subsequences X1', X2', or X3' is substituted, into a population of parental nucleic acids at the positions corresponding to those that encode X1, X2, or X3.

In various instances: at least one of the X1-X3 subsequences is selected from SEQ ID NOs:121-123; each of C1-C4 independently comprises up to 20 single amino acid substitutions, deletions, insertions, or additions to the selected subsequence; each of C1-C4 independently comprises up to 10 single amino acid substitutions, deletions, insertions, or additions to the selected subsequence; each of C1-C4 independently comprises up to 5 single amino acid substitutions, deletions, insertions, or additions to the selected subsequence; none of C1-C4 comprise amino acid substitutions, deletions, insertions, or additions to the selected subsequence; the replicating generates a heterogeneous population of randomly varied subsequences by introducing up to 5 amino acid substitutions in each of X1, X2, or X3; the method further comprises amplifying the library by introducing it into a biological replication system and proliferating the biological replication system; the biological replication system is a plurality of *E. coli* cells; the biological replication system is a plurality of bacteriophage; the replicating occurs in vitro; the replicating is performed with a purified mutagenic polymerase; the replicating is performed in the presence of a nucleotide analog; the replicating occurs in vivo; the replicating in vivo occurs in a mutagenic species of *E. coli*.

Also described is a method of generating the library of claim 1, comprising:(i) selecting an amino acid sequence comprising the amino acid sequence C1-X1-C2-X2 C3 X3-C4 to be encoded, wherein: (a) subsequence C1 is selected from SEQ ID NOs:1-30, subsequence C2 is selected from SEQ ID NOs:31-60, subsequence C3 is selected from SEQ ID NOs:61 90, and subsequence C4 is selected from SEQ ID NOs:91-120; (b) each of C1-C4 comprises up to 10 single amino acid substitutions, deletions, insertions, or additions to the selected subsequence; (c) each of X1, X2, and X3 consists of an amino acid sequence 2-20 amino acids in length; (ii) providing a first plurality and a second plurality of oligonucleotides, wherein: (a) oligonucleotides of the first plurality encode the C1-C4 subsequences and multiple heterogeneous X1-X3 variant subsequences X1'-X3'; (b) oligonucleotides of the second plurality are complementary to nucleotide sequences encoding the C1-C4 subsequences and to nucleotide sequences encoding multiple heterogeneous X1' X3' subsequences; and (c) the oligonucleotides of the first and second pluralities have overlapping sequences complementary to one another; (iii) combining the population of oligonucleotides to form a first mixture; (iv) incubating the mixture under conditions effective for hybridizing the overlapping complementary sequences to form a plurality of hybridized complementary sequences; and (v) elongating the plurality of hybridized complementary sequences to form a second mixture containing the library.

In various instances: each of C1-C4 independently comprises up to 20 single amino acid substitutions, deletions, insertions, or additions to the selected subsequence; each of C1-C4 independently comprises up to 10 single amino acid substitutions, deletions, insertions, or additions to the selected subsequence; each of C1-C4 independently comprises from zero and up to 5 single amino acid substitutions, deletions, insertions, or additions to the selected subsequence; the method further comprises performing a cycle of steps, the cycle of steps comprising denaturing the library by increasing the temperature of the second mixture to a temperature effective for denaturing double stranded DNA, followed by steps (iv) and (v); the method comprises repeating the cycle of steps up to 100 times; the method further comprises amplifying the library by a polymerase chain reaction consisting essentially of the library, a forward primer, and a reverse primer, wherein the forward and reverse primers can hybridize to the 5' and 3' end sequences, respectively, of all nucleic acids in the library; the amino acid to be encoded in each position of the X1, X2, or X3 subsequences, is selected from a subset of alanine, arginine, asparagine, aspartate, cysteine, glutamine, glutamate, glycine, histidine, isoleucine, leucine, lysine, methionine, phenylalanine, proline, serine, threonine, tryptophan, tyrosine, and valine; herein the amino acid selected for each single amino acid substitution is selected from a group of amino acids consisting of at least one aliphatic, at least one acidic, at least one neutral, and at least one aromatic amino acid; and the group of amino acids consists of alanine, aspartate, serine, and tyrosine.

Also described herein is a method of generating a library, comprising: (i) providing a parental nucleic acid encoding a parental polypeptide comprising the amino acid sequence: C1-X1-C2-X2-C3-X3-C4, wherein subsequence C1 is selected from FIG. 2 or FIG. 4, subsequence C2 is selected from FIG. 2 or FIG. 4, subsequence C3 is selected from FIG. 2 or FIG. 4; subsequence C4 is selected from FIG. 2 or FIG. 4 each of C1-C4 comprises up to 10 single amino acid substitutions, deletions, insertions, or additions to the selected subsequence; and each of X1-X3 is an independent subsequence consisting of 2-20 amino acids; (ii) replicating the parental nucleic acid under conditions that introduce up to 10 single amino acid substitutions, deletions, insertions, or additions to the X1, X2, or X3 subsequences, whereby a population of randomly varied subsequences encoding X1', X2', or X3' is generated; and (iii) the population of randomly varied subsequences X1', X2', or X3' is substituted, into a population of parental nucleic acids at the positions corresponding to those that encode X1, X2, or X3.

In various embodiments: at least one of the X1-X3 subsequences is selected from SEQ ID NOs:121-123; each of C1-C4 independently comprises up to 20 single amino acid substitutions, deletions, insertions, or additions to the selected subsequence; each of C1-C4 independently comprises up to 10 single amino acid substitutions, deletions, insertions, or additions to the selected subsequence; each of C1-C4 independently comprises up to 5 single amino acid substitutions, deletions, insertions, or additions to the selected subsequence; none of C1-C4 comprise an amino acid substitutions, deletions, insertions, or additions to the selected subsequence; the replicating generates a heterogeneous population of randomly varied subsequences by introducing up to 5 amino acid substitutions in each of X1, X2, or X3; the method further comprises amplifying the library by introducing it into a biological replication system and proliferating the biological replication system; the biological replication system is a plurality of *E. coli* cells; the biological replication system is a plurality of bacteriophage; the replicating occurs in vitro; the replicating is performed with a purified mutagenic polymerase the replicating is performed in the presence of a nucleotide analog; the replicating occurs in vivo; and the replicating in vivo occurs in a mutagenic species of *E. coli*.

Also described is a method of generating the library, comprising: (i) selecting an amino acid sequence comprising C1-X1-C2-X2 C3 X3-C4 to be encoded, wherein (a) subsequence C1 is selected from FIG. 2 or FIG. 4, subsequence C2 is selected from FIG. 2 or FIG. 4, subsequence C3 is selected from FIG. 2 or FIG. 4, and subsequence C4 is selected from FIG. 2 or FIG. 4; (b) each of C1-C4 comprises up to 10 single amino acid substitutions, deletions, insertions, or additions to the selected subsequence; (c) each of X1, X2, and X3 consists of an amino acid sequence 2-20 amino acids in length; (ii) providing a first plurality and a second plurality of oligonucleotides, wherein (a) oligonucleotides of the first plurality encode the C1-C4 subsequences and multiple heterogeneous X1-X3 variant subsequences X1'-X3'; (b) oligonucleotides of the second plurality are complementary to nucleotide sequences encoding the C1-C4 subsequences and to nucleotide sequences encoding multiple heterogeneous X1' X3' subsequences; and (c) the oligonucleotides of the first and second pluralities have overlapping sequences complementary to one another; (iii) combining the population of oligonucleotides to form a first mixture; (iv) incubating the mixture under conditions effective for hybridizing the overlapping complementary sequences to form a plurality of hybridized complementary sequences; and (v) elongating the plurality of hybridized complementary sequences to form a second mixture containing the library.

In various cases: each of C1-C4 independently comprises up to 20 single amino acid substitutions, deletions, insertions, or additions to the selected subsequence; each of C1-C4 independently comprises up to 10 single amino acid substitutions, deletions, insertions, or additions to the selected subsequence; each of C1-C4 independently comprises from zero and up to 5 single amino acid substitutions, deletions, insertions, or additions to the selected subsequence; the method further comprises performing a cycle of steps, the cycle of steps comprising denaturing the library by increasing the temperature of the second mixture to a temperature effective for denaturing double stranded DNA, followed by steps (iv) and (v); the method further comprises repeating the cycle of steps up to 100 times; the method further comprises amplifying the library by a polymerase chain reaction consisting essentially of the library, a forward primer, and a reverse primer, wherein the forward and reverse primers can hybridize to the 5' and 3' end sequences, respectively, of all nucleic acids in the library; the amino acid to be encoded in each position of the X1, X2, or X3 subsequences, is selected from a subset of alanine, arginine, asparagine, aspartate, cysteine, glutamine, glutamate, glycine, histidine, isoleucine, leucine, lysine, methionine, phenylalanine, proline, serine, threonine, tryptophan, tyrosine, and valine; the amino acid selected for each single amino acid substitution is selected from a group of amino acids consisting of at least one aliphatic, at least one acidic, one at least one neutral, and at least one aromatic amino acid; and the group of amino acids consists of alanine, aspartate, serine, and tyrosine.

Also disclosed is a method of generating the library, comprising: (i) providing a parental nucleic acid encoding a parental polypeptide comprising the amino acid sequence: C1-X1-C2-X2-C3-X3-C4, wherein subsequence C1 is selected from FIG. 3 or FIG. 5, subsequence C2 is selected from FIG. 3 or FIG. 5, subsequence C3 is selected from FIG. 3 or FIG. 5; subsequence C4 is selected from FIG. 3 or FIG. 5; each of C1-C4 comprises up to 10 single amino acid substitutions, deletions, insertions, or additions to the selected subsequence; and each of X1-X3 is an independent subsequence consisting of 2-20 amino acids; (ii) replicating the parental nucleic acid under conditions that introduce up to 10 single amino acid substitutions, deletions, insertions, or additions to the X1, X2, or X3 subsequences, whereby a population of randomly varied subsequences encoding X1', X2', or X3' is generated; and (iii) the population of randomly varied subsequences X1', X2', or X3' is substituted, into a population of parental nucleic acids at the positions corresponding to those that encode X1, X2, or X3.

In various instances: at least one of the X1-X3 subsequences is selected from SEQ ID NOs:121-123; each of C1-C4 independently comprises up to 20 single amino acid substitutions, deletions, insertions, or additions to the selected subsequence; each of C1-C4 independently comprises up to 10 single amino acid substitutions, deletions, insertions, or additions to the selected subsequence; each of C1-C4 independently comprises up to 5 single amino acid substitutions, deletions, insertions, or additions to the selected subsequence; none of C1-C4 comprise amino acid substitutions, deletions, insertions, or additions to the selected subsequence; the replicating generates a heterogeneous population of randomly varied subsequences by introducing up to 5 amino acid substitutions in each of X1, X2, or X3; the method further comprises amplifying the library by introducing it into a biological replication system and proliferating the biological replication system; the biological replication system is a plurality of *E. coli* cells; the biological replication system is a plurality of bacteriophage; the replicating occurs in vitro; the replicating is performed with a purified mutagenic polymerase; the replicating is performed in the presence of a nucleotide analog; the replicating occurs in vivo; and the replicating in vivo occurs in a mutagenic species of *E. coli*.

Also described is a method of generating the library, comprising: (i) selecting an amino acid sequence comprising: C1-X1-C2-X2 C3 X3-C4 to be encoded, wherein (a) subsequence C1 is selected from FIG. 3 or FIG. 5, subsequence C2 is selected from FIG. 3 or FIG. 5, subsequence C3 is selected from FIG. 3 or FIG. 5, and subsequence C4 is selected from FIG. 3 or FIG. 5; (b) each of C1-C4 comprises up to 10 single amino acid substitutions, deletions, insertions, or additions to the selected subsequence; (c) each of X1, X2, and X3 consists of an amino acid sequence 2-20 amino acids in length; (ii) providing a first plurality and a second plurality of oligonucleotides, wherein (a) oligonucleotides of the first plurality encode the C1-C4 subsequences and multiple heterogeneous X1-X3 variant subsequences X1'-X3'; (b) oligonucleotides of the second plurality are complementary to nucleotide sequences encoding the C1-C4 subsequences and to nucleotide sequences encoding multiple heterogeneous X1' X3' subsequences; and (c) the oligonucleotides of the first and second pluralities have overlapping sequences complementary to one another; (iii) combining the population of oligonucleotides to form a first mixture; (iv) incubating the mixture under conditions effective for hybridizing the overlapping complementary sequences to form a plurality of hybridized complementary sequences; and (v) elongating the plurality of hybridized complementary sequences to form a second mixture containing the library.

In various embodiments: each of C1-C4 comprises up to 20 single amino acid substitutions, deletions, insertions, or additions to the selected subsequence; each of C1-C4 independently comprises up to 10 single amino acid substitutions, deletions, insertions, or additions to the selected subsequence; each of C1-C4 independently comprises from zero and up to 5 single amino acid substitutions, deletions, insertions, or additions to the selected subsequence; the method further comprises performing a cycle of steps, the cycle comprising denaturing the library by increasing the temperature of the second mixture to a temperature effective for denaturing double stranded DNA, followed by steps (iv) and (v); the method further comprises repeating the cycle up to 100 times; the method further comprises amplifying the library by a polymerase chain reaction consisting essentially of the library, a forward primer, and a reverse primer, wherein the forward and reverse primers can hybridize to the 5' and 3' end sequences, respectively, of all nucleic acids in the library; the amino acid to be encoded in each position of the X1, X2, or X3 subsequences, is selected from a subset of alanine, arginine, asparagine, aspartate, cysteine, glutamine, glutamate, glycine, histidine, isoleucine, leucine, lysine, methionine, phenylalanine, proline, serine, threonine, tryptophan, tyrosine, and valine the amino acid selected for each single amino acid substitution is selected from a group of amino acids consisting of at least one aliphatic, one acidic, one neutral, and one aromatic amino acid; and the group of amino acids consists of alanine, aspartate, serine, and tyrosine.

Also described is a library of nucleic acids encoding at least ten different polypeptides, wherein: (i) the amino acid sequence of each of the encoded polypeptides comprises an amino acid sequence at least 70% identical to any of SEQ ID NOs:127-129; (ii) the amino acid sequence of each of the encoded polypeptides includes amino acids that differ from those of SEQ ID NOs:127-129 at positions 14, 15, 33, 35-36, 38, 47-48, 66, 68-69, 71, 80, 81, 99, 101-102, and 104, and the amino acid differences are heterogeneous across a plurality of the encoded polypeptides; and (iii) the amino acid sequence of each of the encoded polypeptides outside of the residues corresponding to positions 14, 15, 33, 35-36, 38, 47-48, 66, 68-69, 71, 80, 81, 99, 101-102, and 104 of SEQ ID NOs: 127-129 is homogeneous across a plurality of the encoded polypeptides.

In various embodiments: the amino acid sequence of the polypeptides has at least 75% identity to any of SEQ ID NOs 127-129; the amino acid sequence of the polypeptides has at least 80% identity to any of SEQ ID NOs 127-129; and the amino acid sequence of the polypeptides has at least 85% identity to any of SEQ ID NOs 127-129 each of the nucleic acids comprises a vector sequence. Also disclosed: an isolated nucleic acid encoding a polypeptide, selected from the library; a purified polypeptide encoded by the nucleic acid; a population of cells expressing the polypeptides encoded by the library; a cell selected from the population of cells; a purified library of polypeptides encoded by the library; a population of filamentous phage displaying the library of polypeptides encoded by the library.

Also disclosed is a method of generating the library, comprising: (i) selecting an amino acid sequence corresponding to any one of SEQ ID NOs: 127 129 to be encoded, wherein the selected sequence differs from those of SEQ ID NOs:127-129 in at least one of variable positions 14, 15, 33, 35-36, 38, 47-48, 66, 68-69, 71, 80, 81, 99, 101-102, and 104; (ii) chemically providing a first and a second plurality of oligonucleotides, wherein (a) oligonucleotides of the first plurality encode amino acid subsequences of the selected amino acid sequence; the subsequences being heterogeneous at the encoded variable positions; (b) oligonucleotides of the second plurality are complementary to nucleotide sequences encoding subsequences of the selected amino acid sequence, the subsequences being heterogeneous at the encoded variable positions; and (c) the first and second pluralities comprise oligonucleotides have overlapping sequences complementary to one another; (iii) combining the population of oligonucleotides to form a first mixture; (iv) incubating the mixture under conditions effective for hybridizing the overlapping complementary sequences to form a plurality of hybridized complementary sequences; and (v) elongating the plurality of hybridized complementary sequences to form a second mixture containing the library.

In various instances: the method further comprises performing a cycle of denaturing the library by increasing the temperature of the second mixture to a temperature effective for denaturing double stranded DNA, followed by steps (iv) and (v); the method further comprises repeating the cycle up to 100 times; the method further comprises amplifying the library by a polymerase chain reaction consisting essentially of the library, a forward primer, and a reverse primer, wherein the forward and reverse primers can hybridize to the 5' and 3' end sequences, respectively, of all nucleic acids in the library;

the amino acids to be encoded for the variable positions, are selected from a subset of alanine, arginine, asparagine, aspartate, cysteine, glutamine, glutamate, glycine, histidine, isoleucine, leucine, lysine, methionine, phenylalanine, proline, serine, threonine, tryptophan, tyrosine, and valine the amino acids selected for the variable positions are selected from a group consisting of an aliphatic, an acidic, a neutral, and an aromatic amino acid; the group of amino acids consists of alanine, aspartate, serine, and tyrosine.

The details of one or more embodiments of the invention are set forth in the description below. Other features, objects, and advantages of the invention will be apparent from the description and drawings, and from the claims.

DESCRIPTION OF DRAWINGS

Figure 3A:
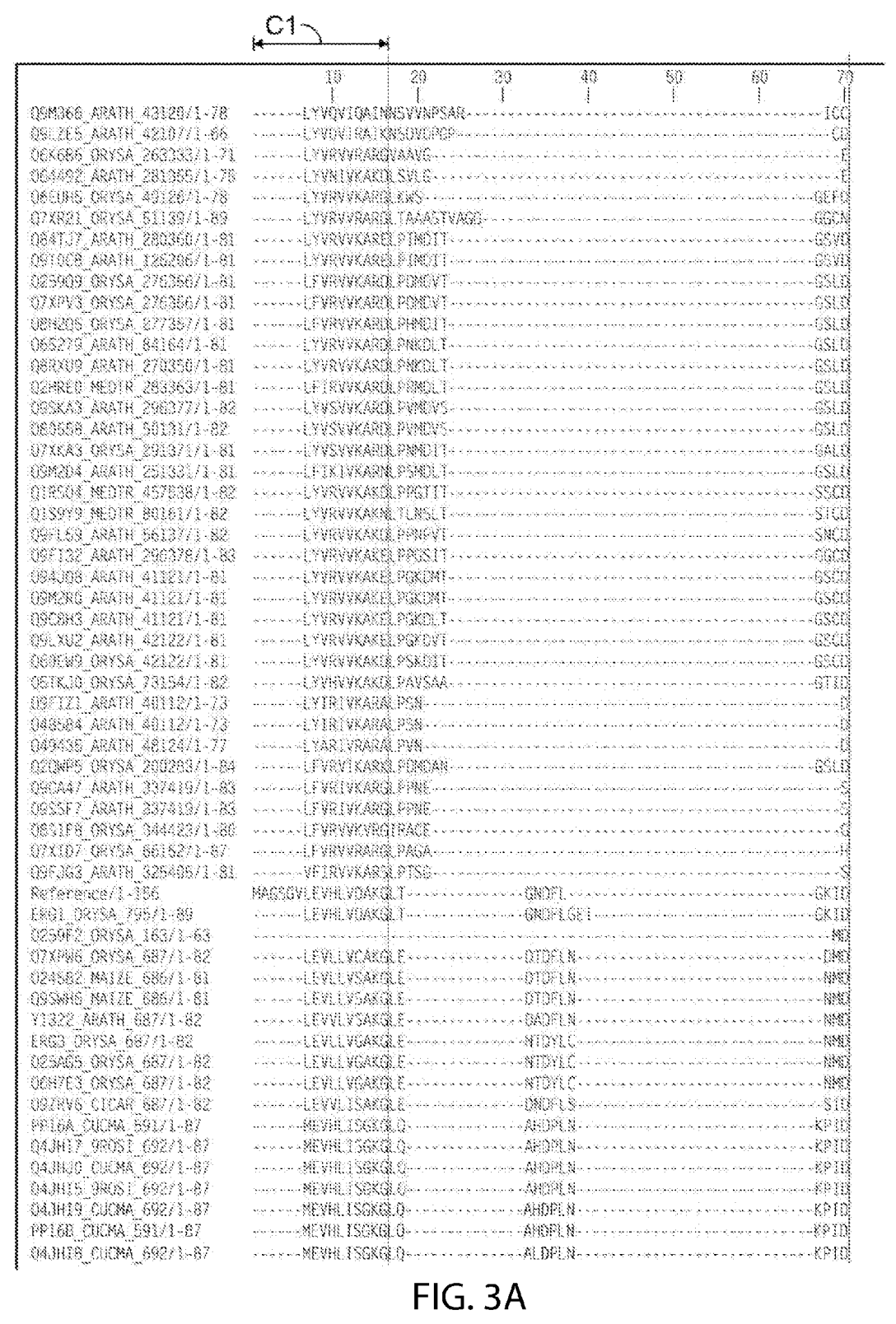
Figure 3B:
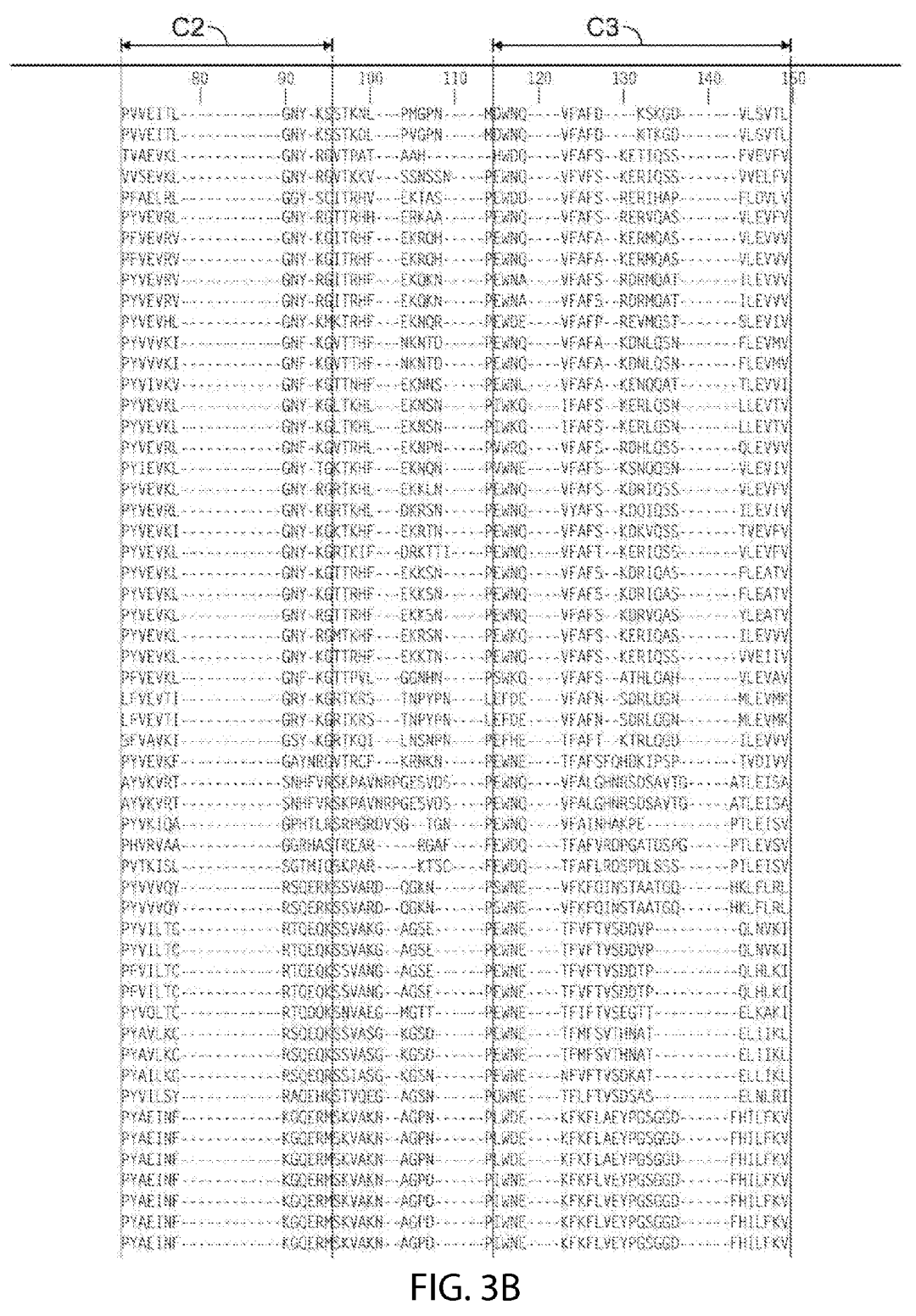
Figure 3C:
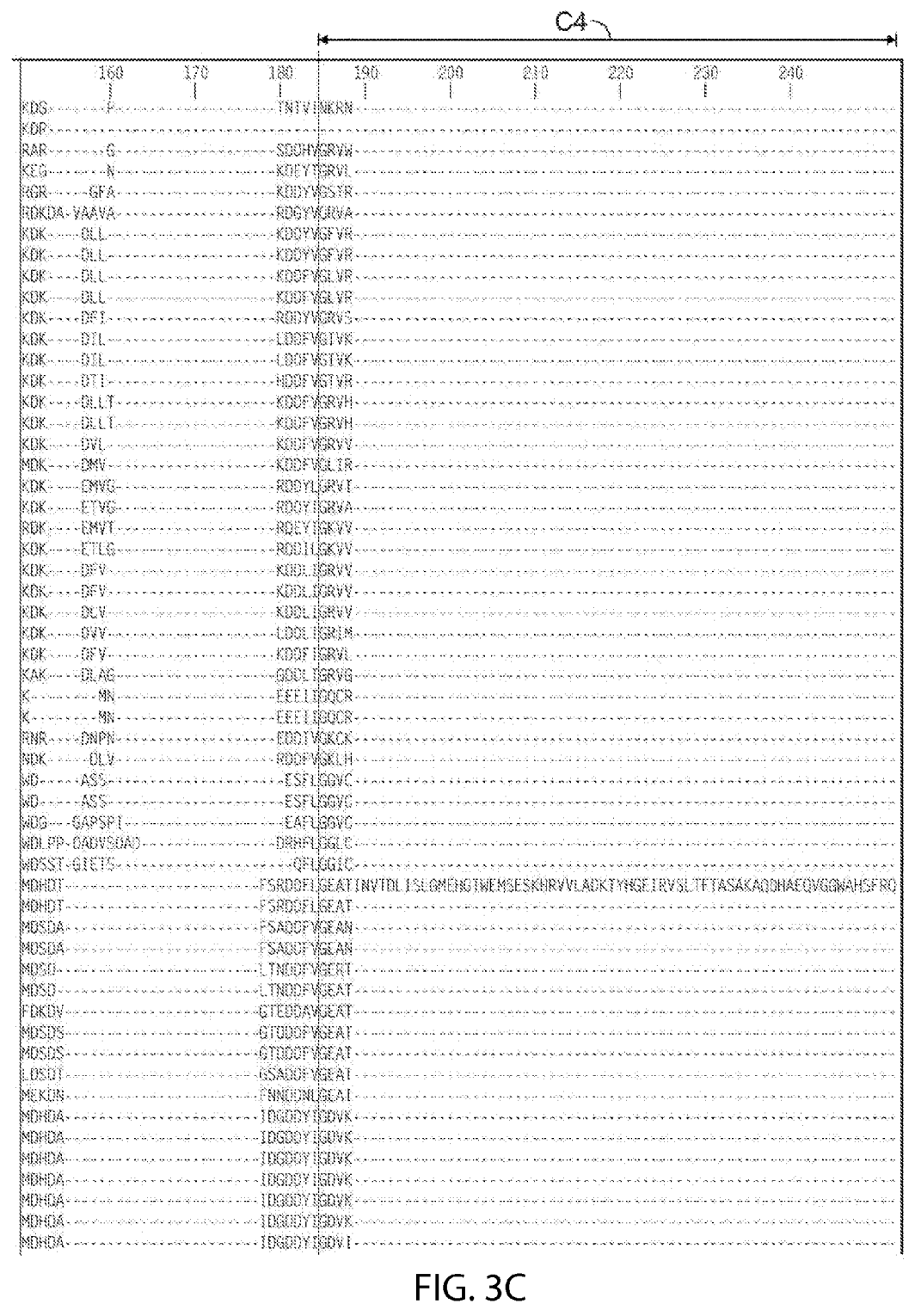
Figure 3D:
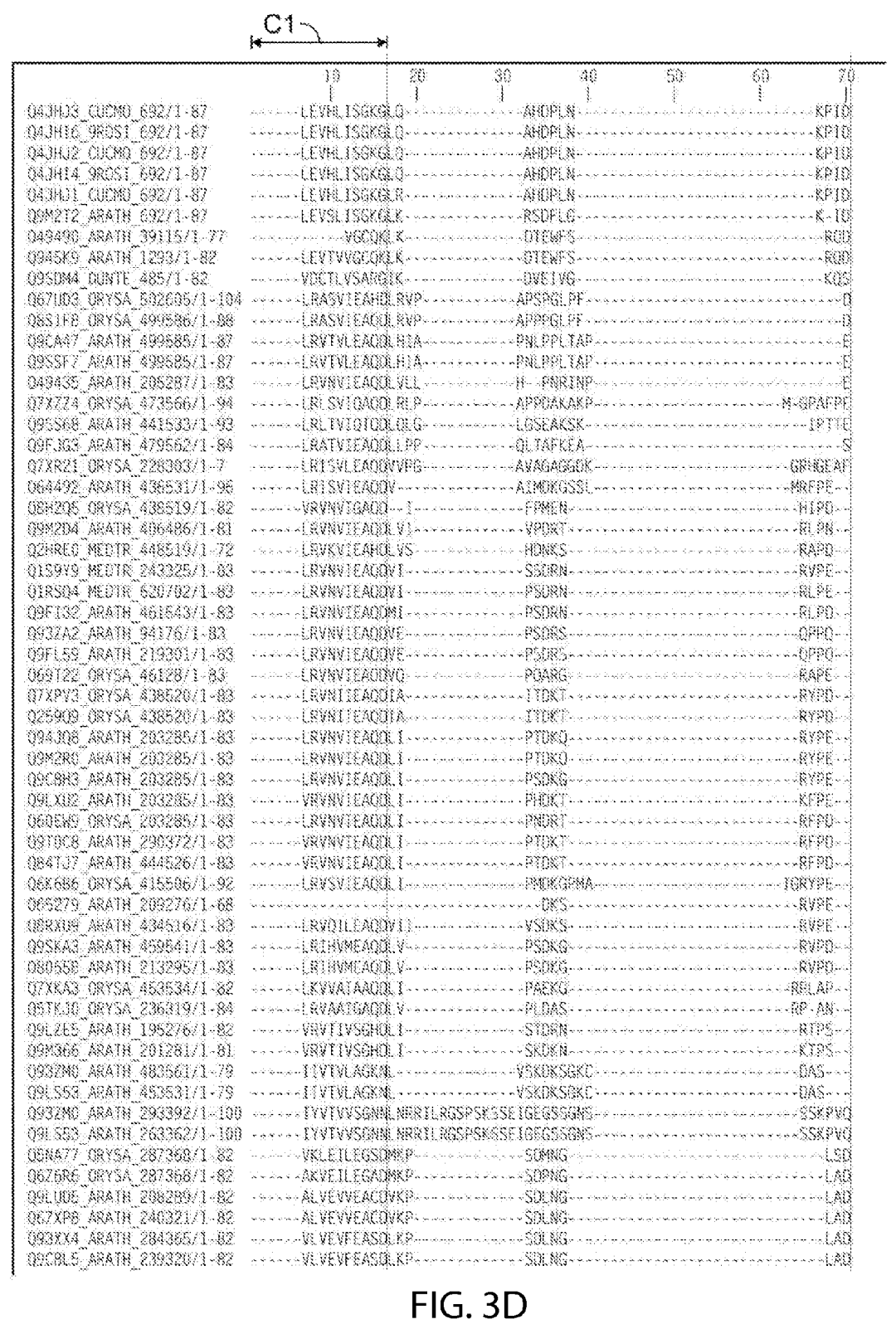
Figure 3E:
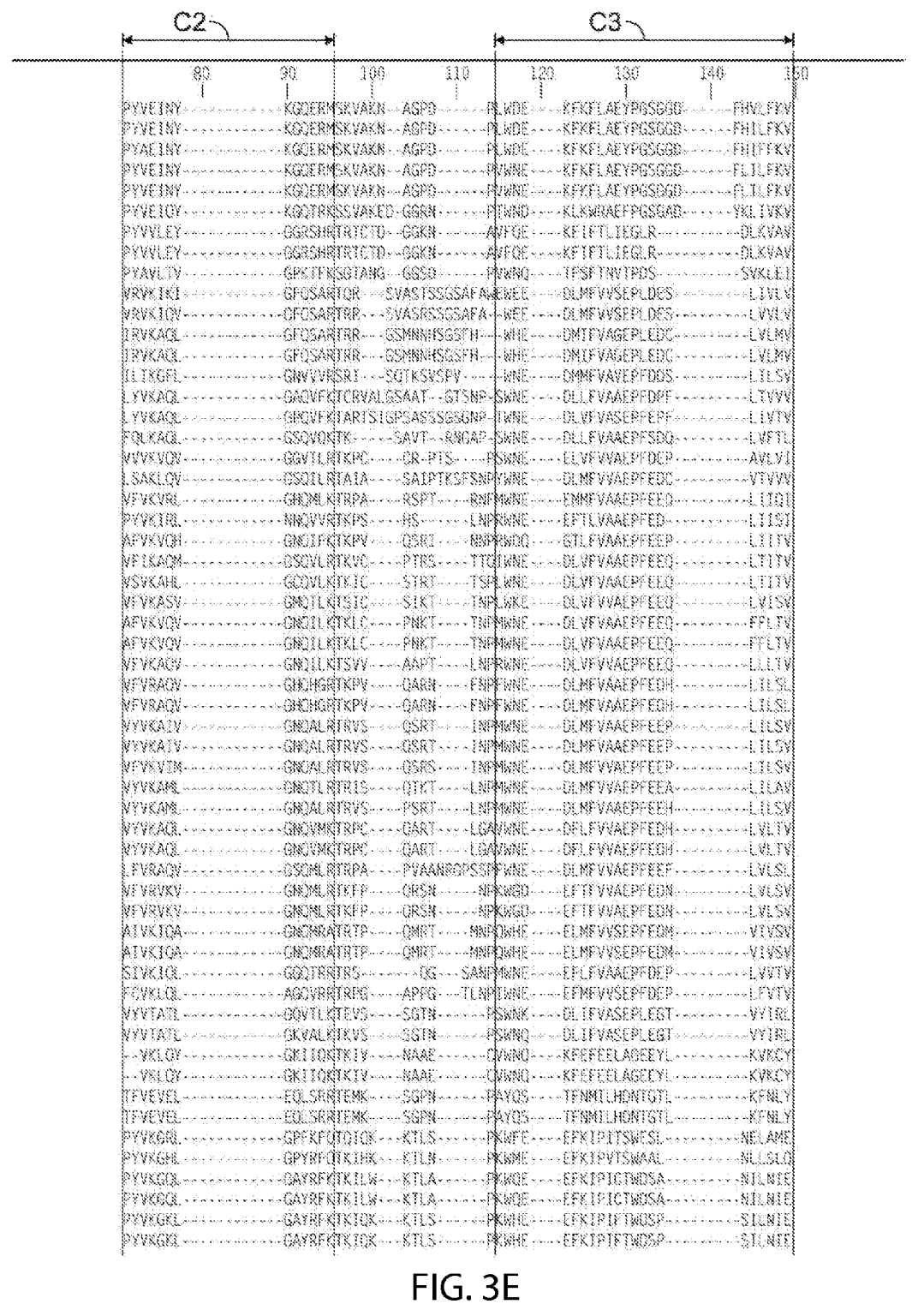
Figure 3F:
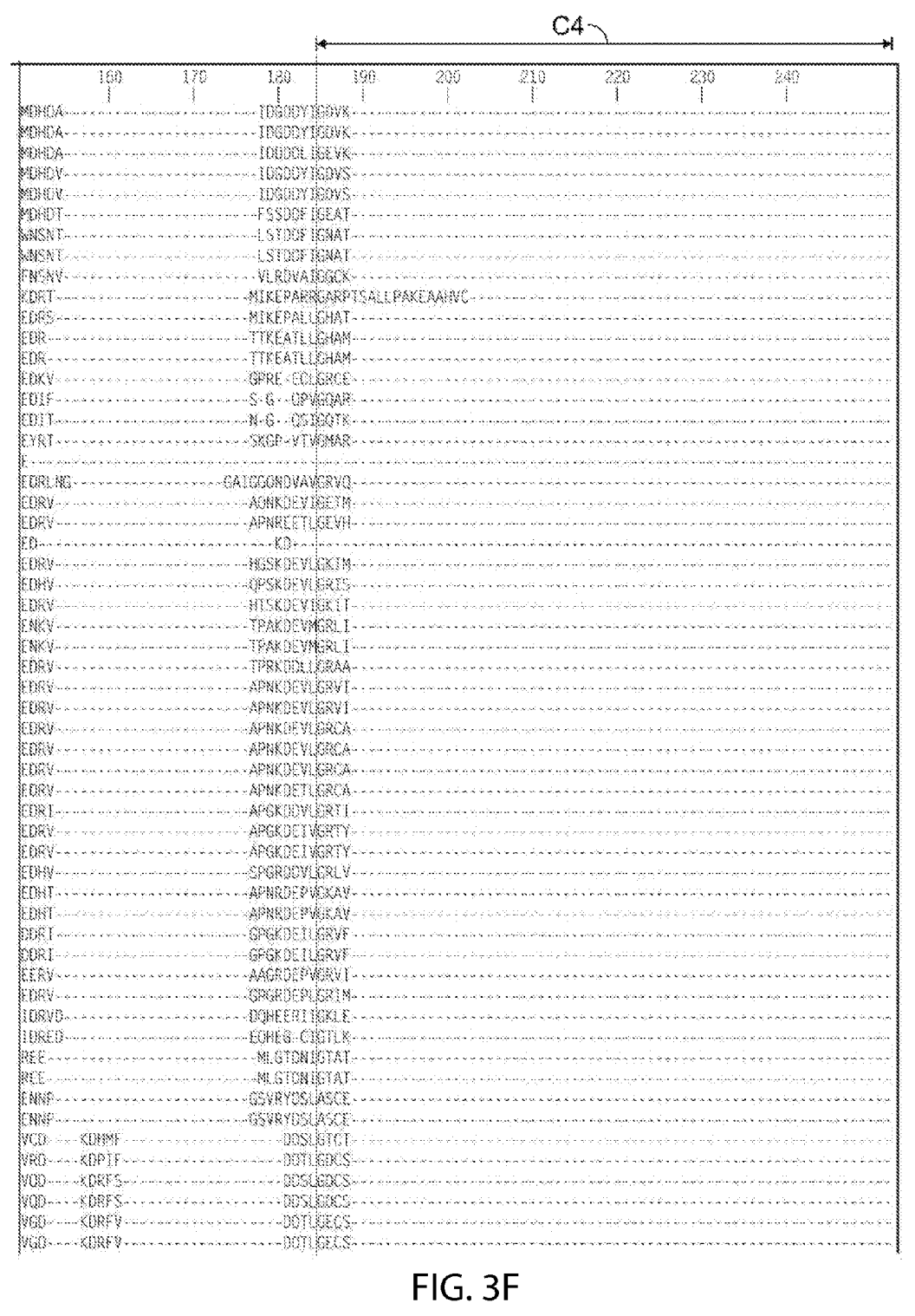
Figure 3G:
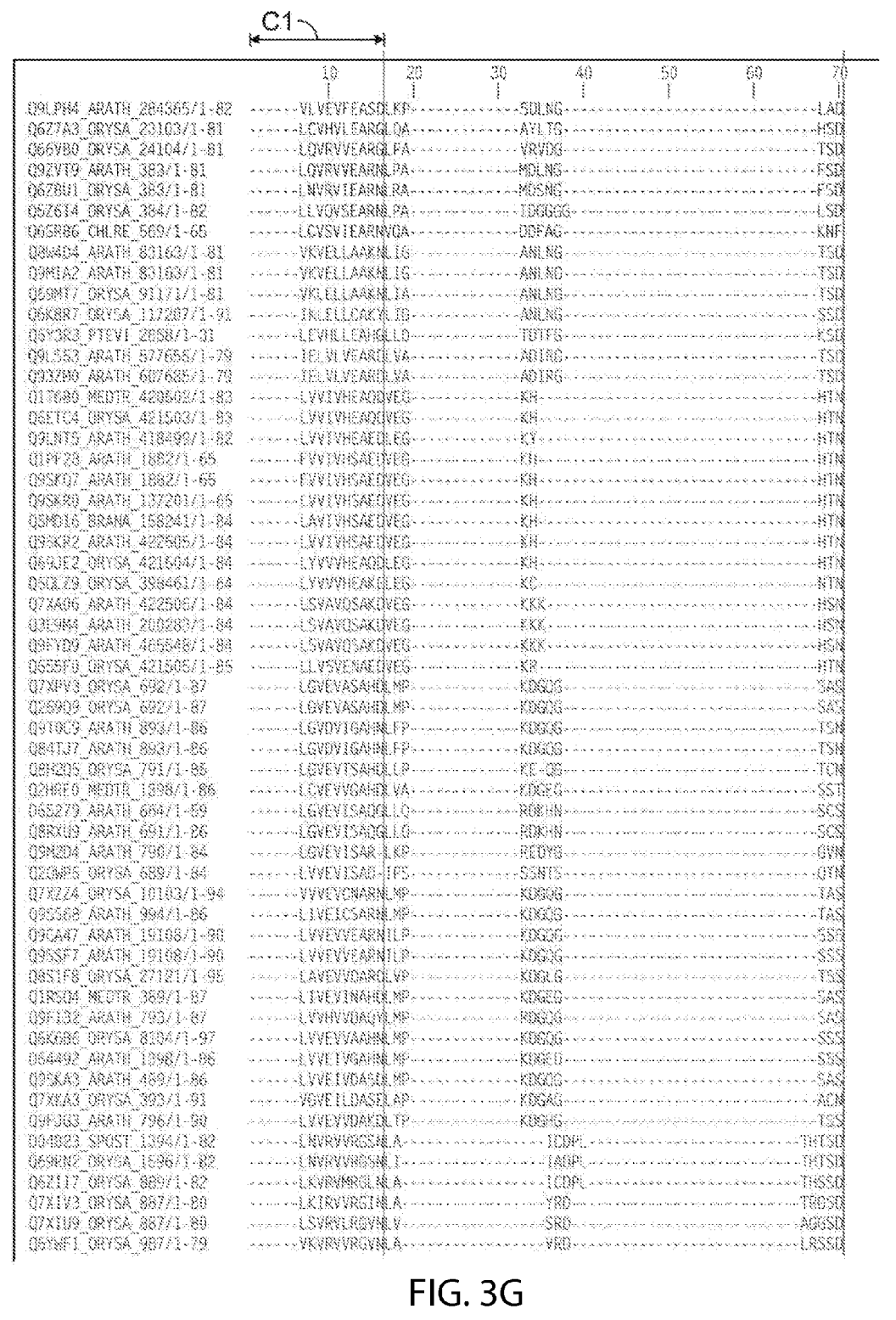
Figure 3H:
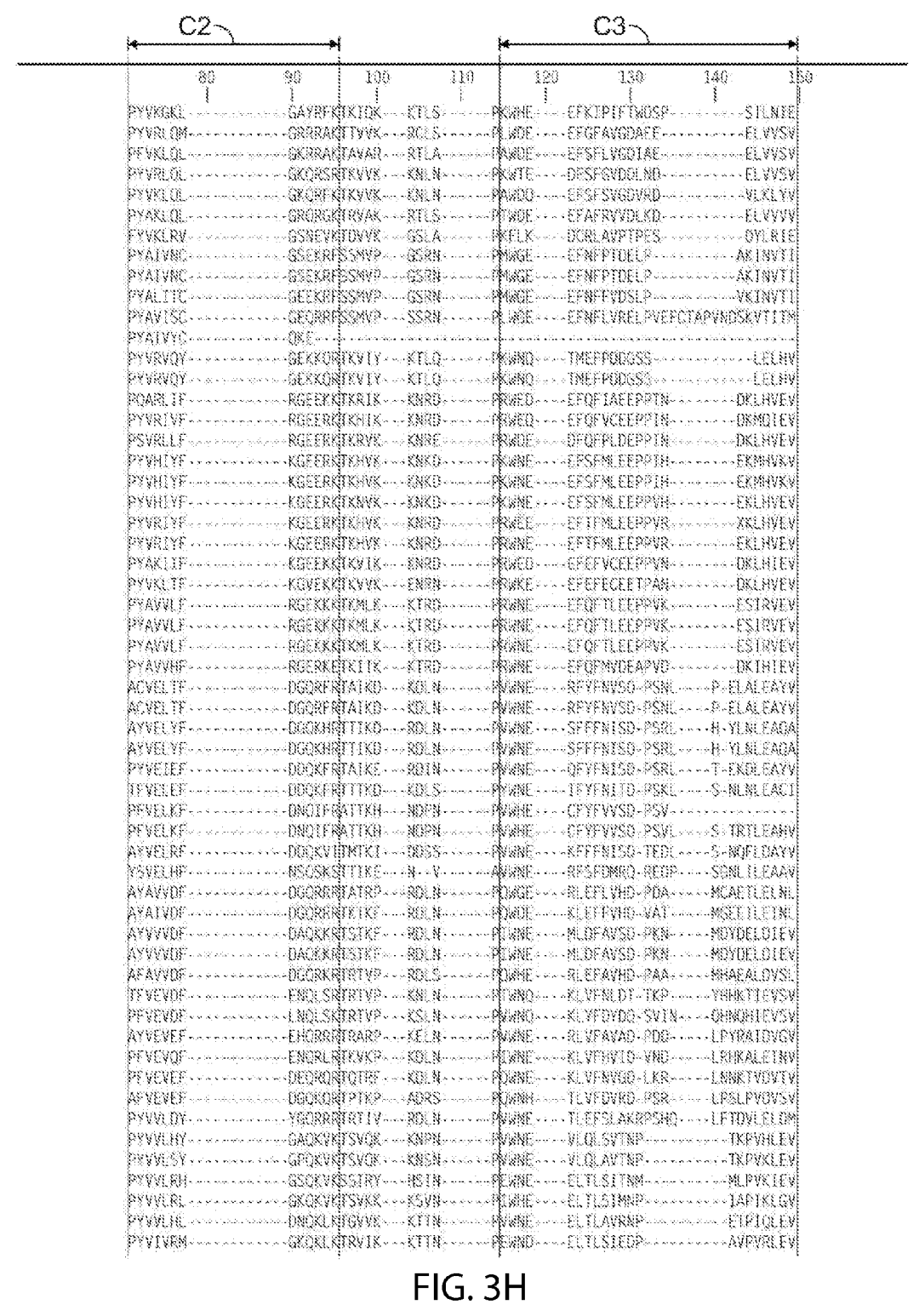
Figure 3I:
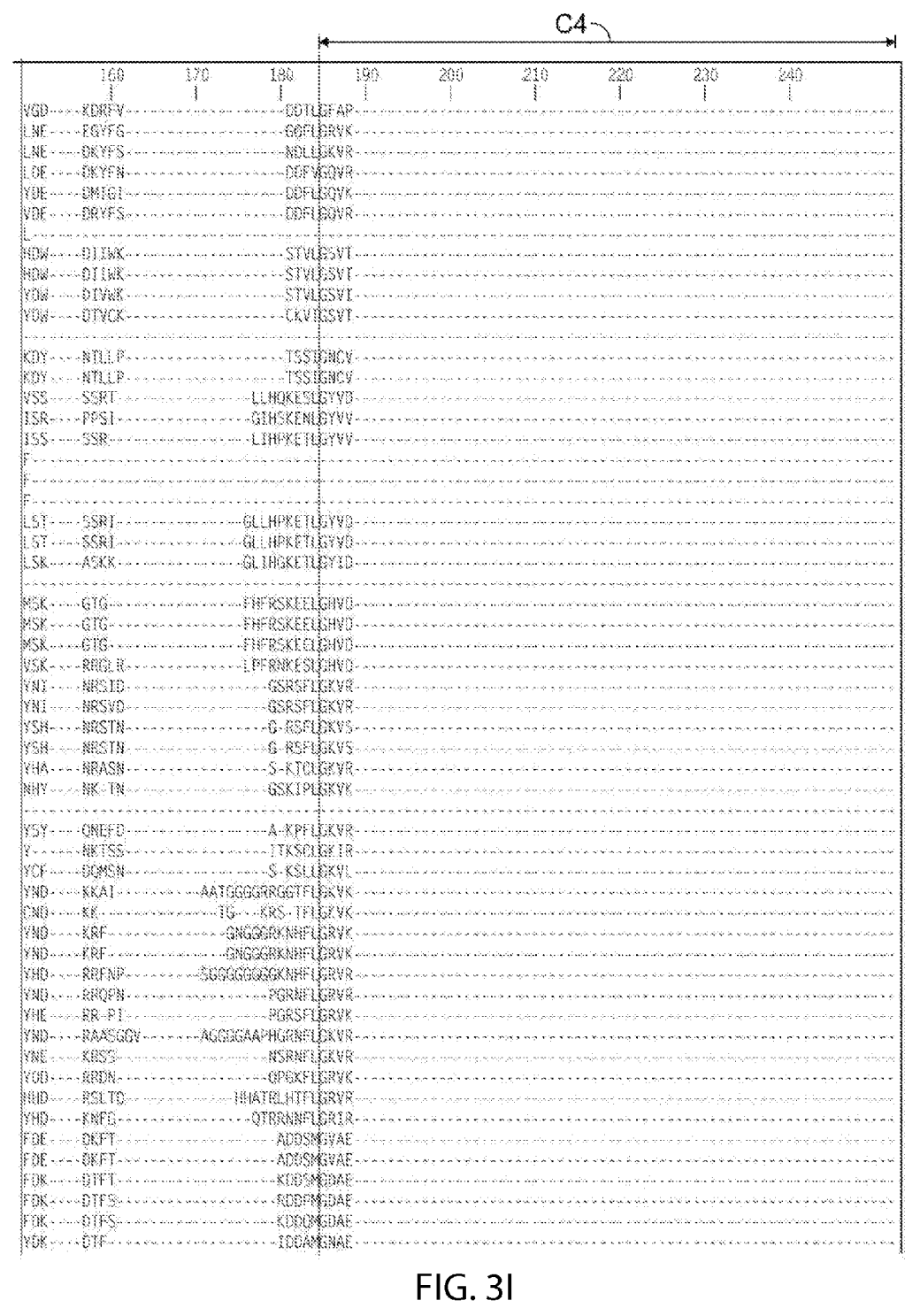
Figure 3J:
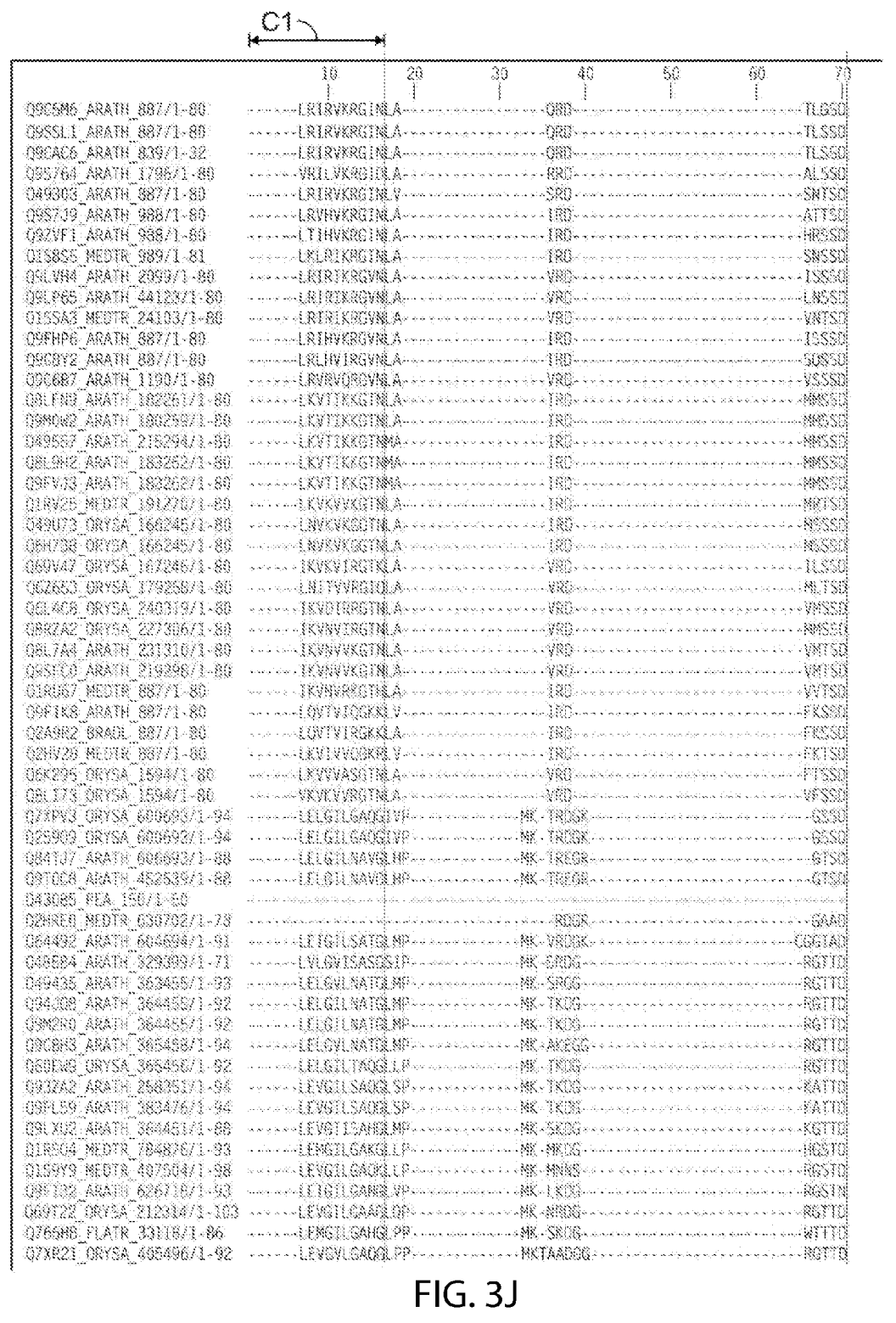
Figure 3K:
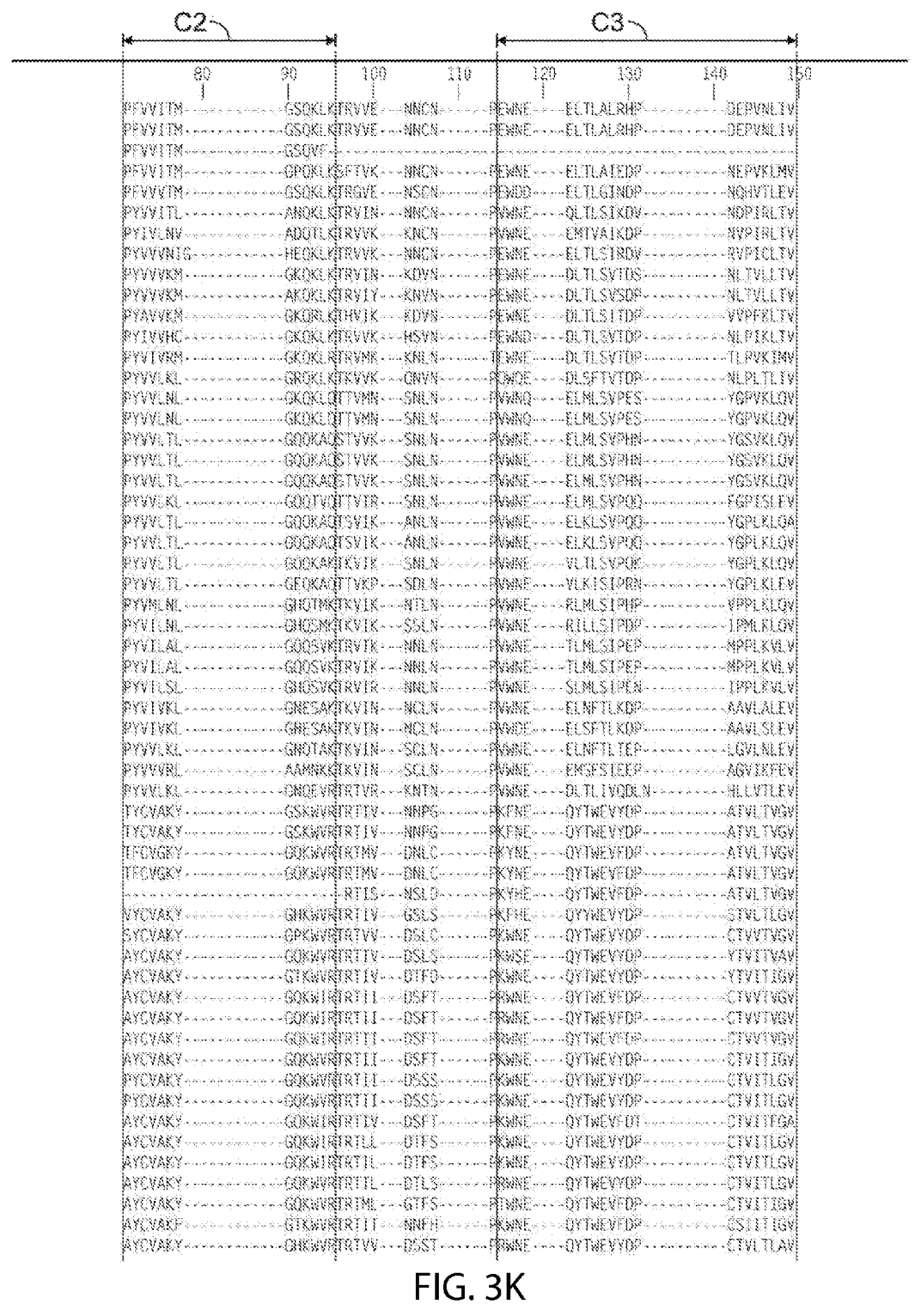
Figure 3L:
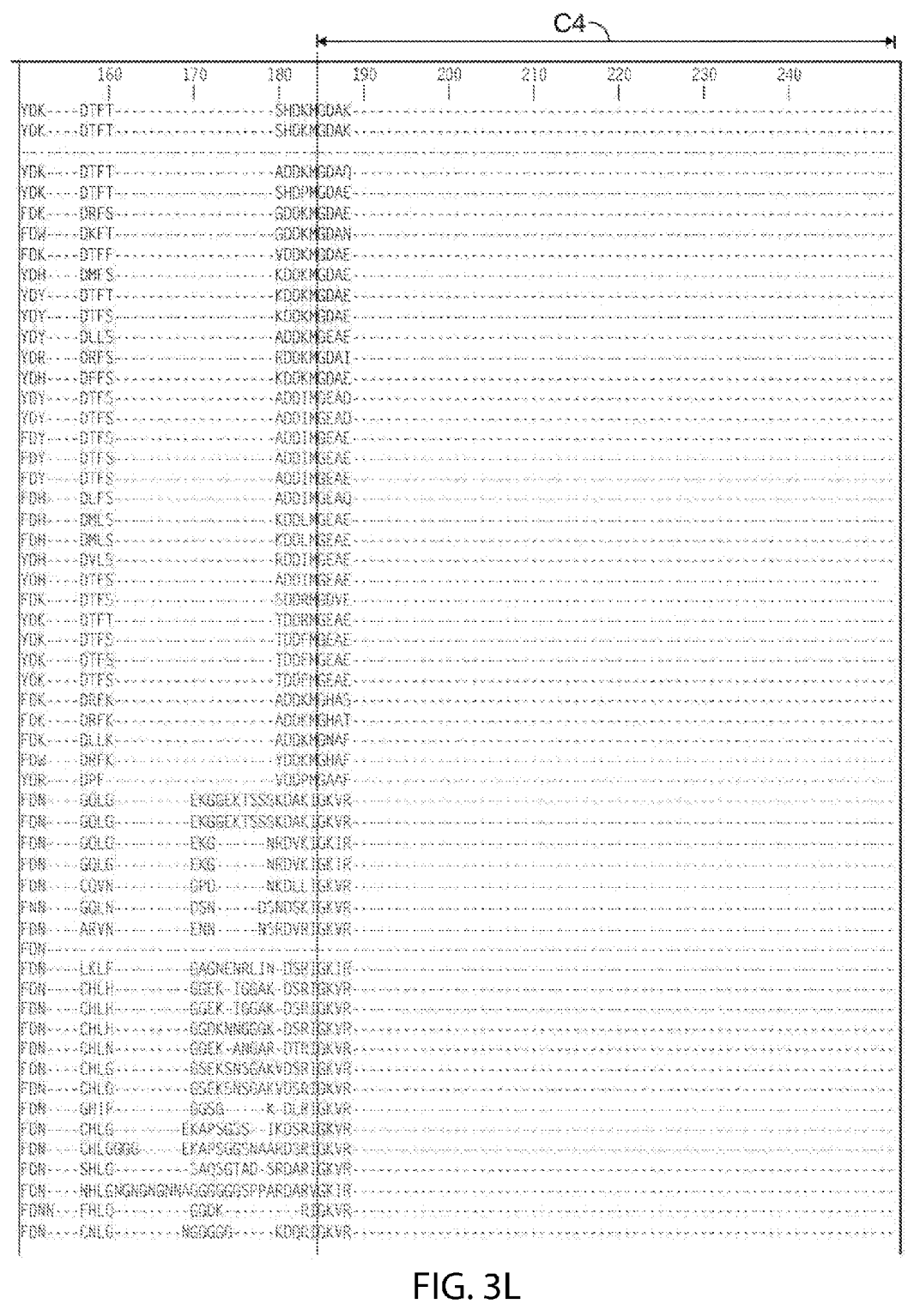
Figure 3M:
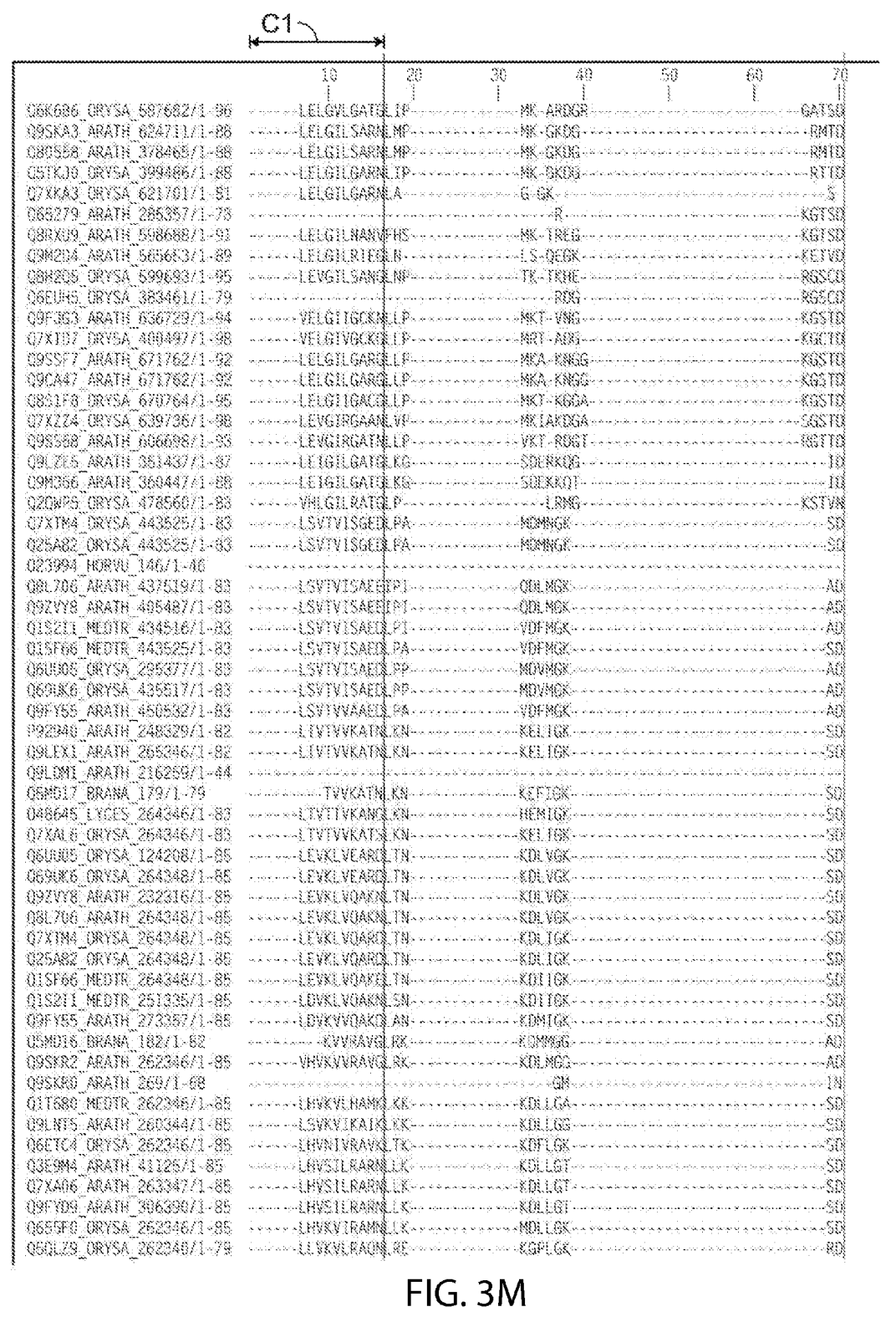
Figure 3N:
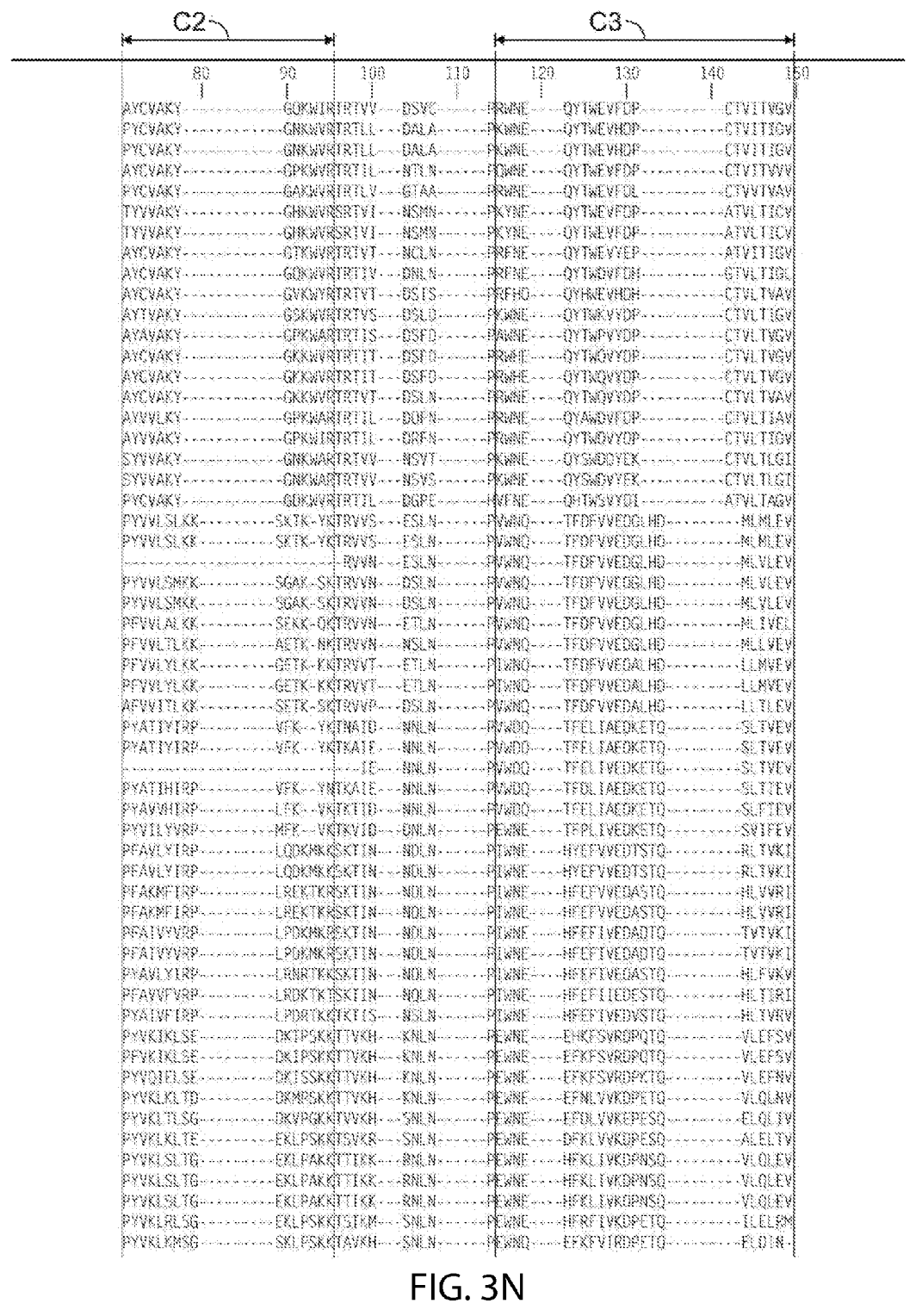
Figure 3O:
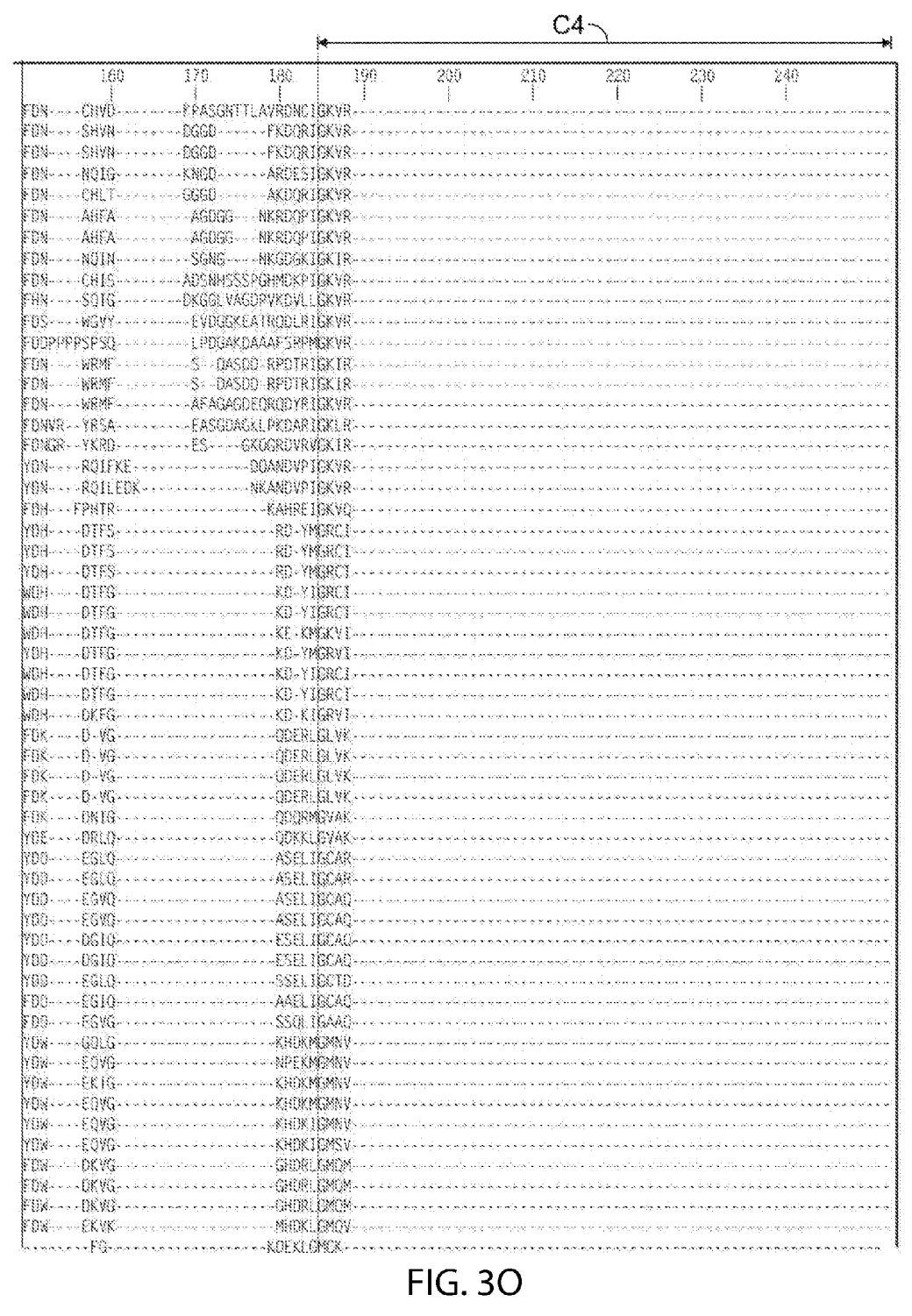
Figure 3P:
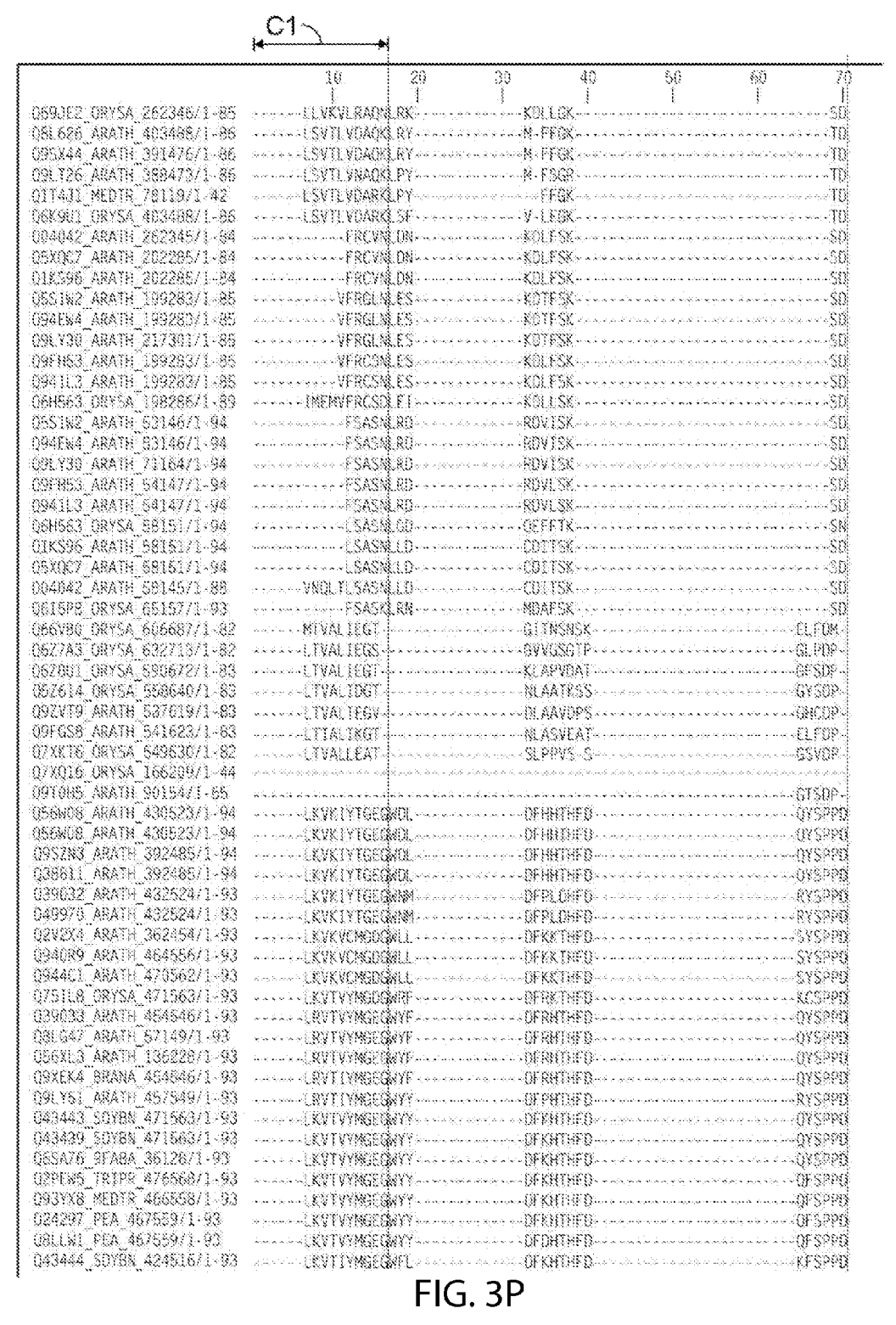
Figure 3Q:
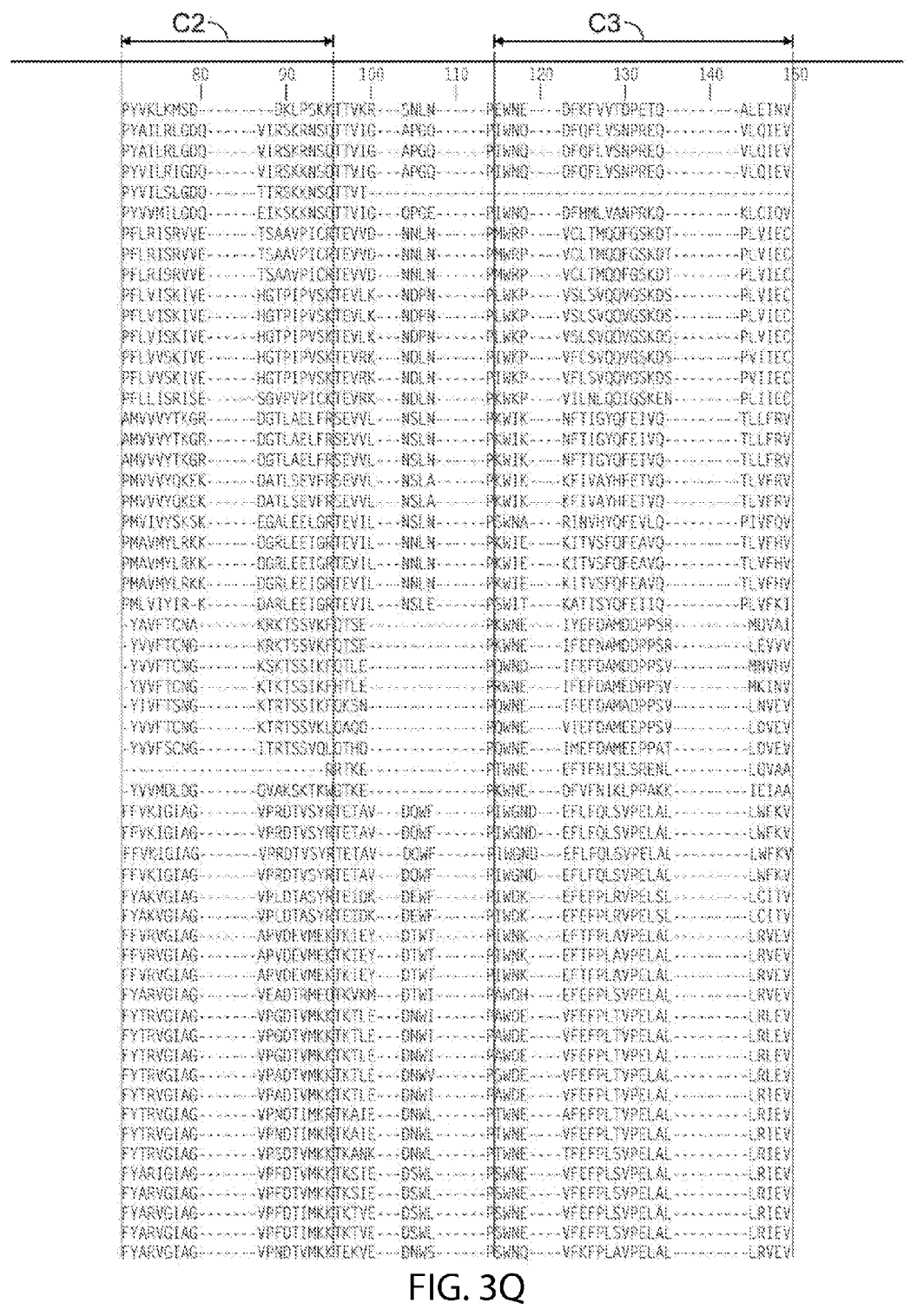
Figure 3R:
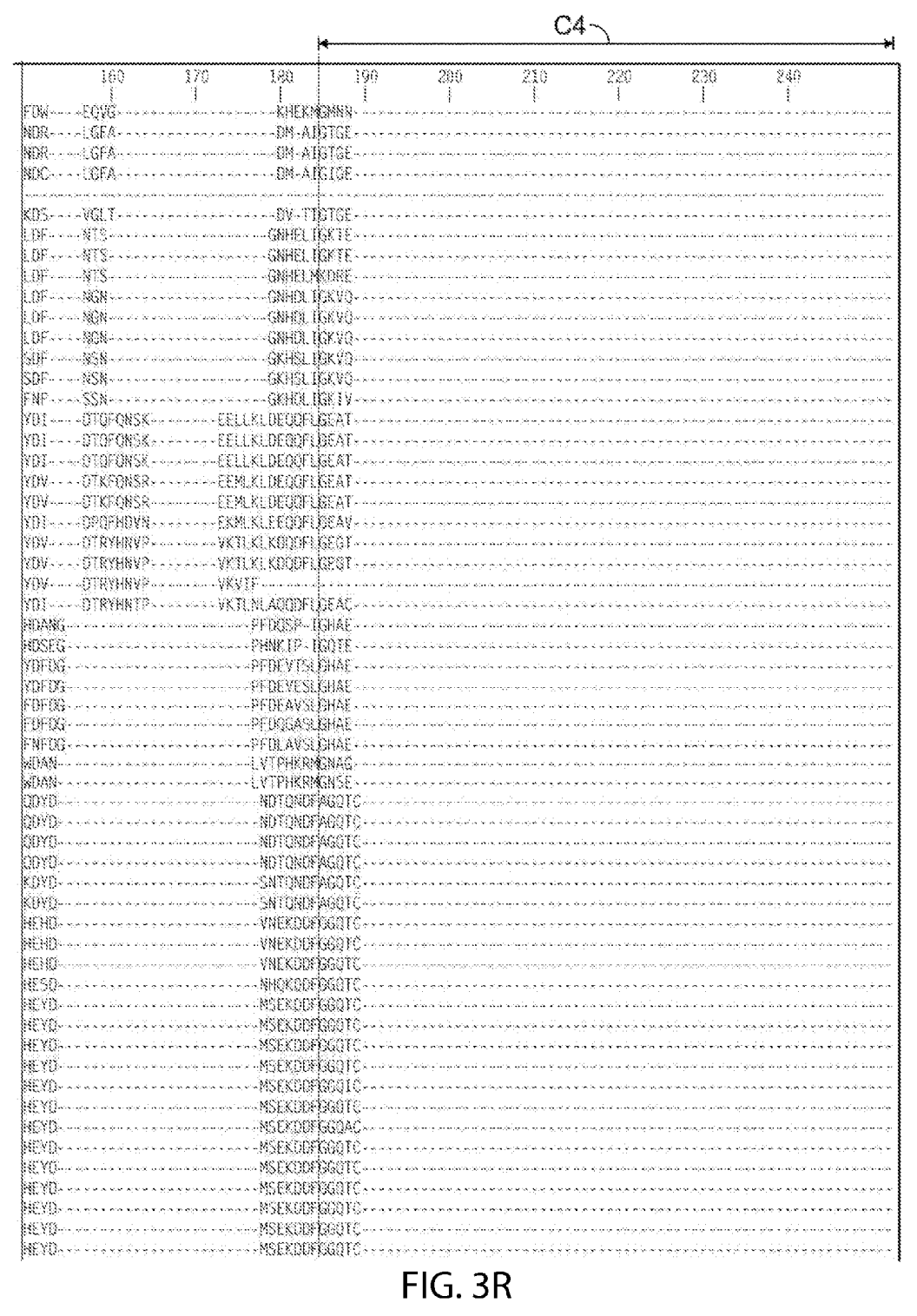
Figure 3S:
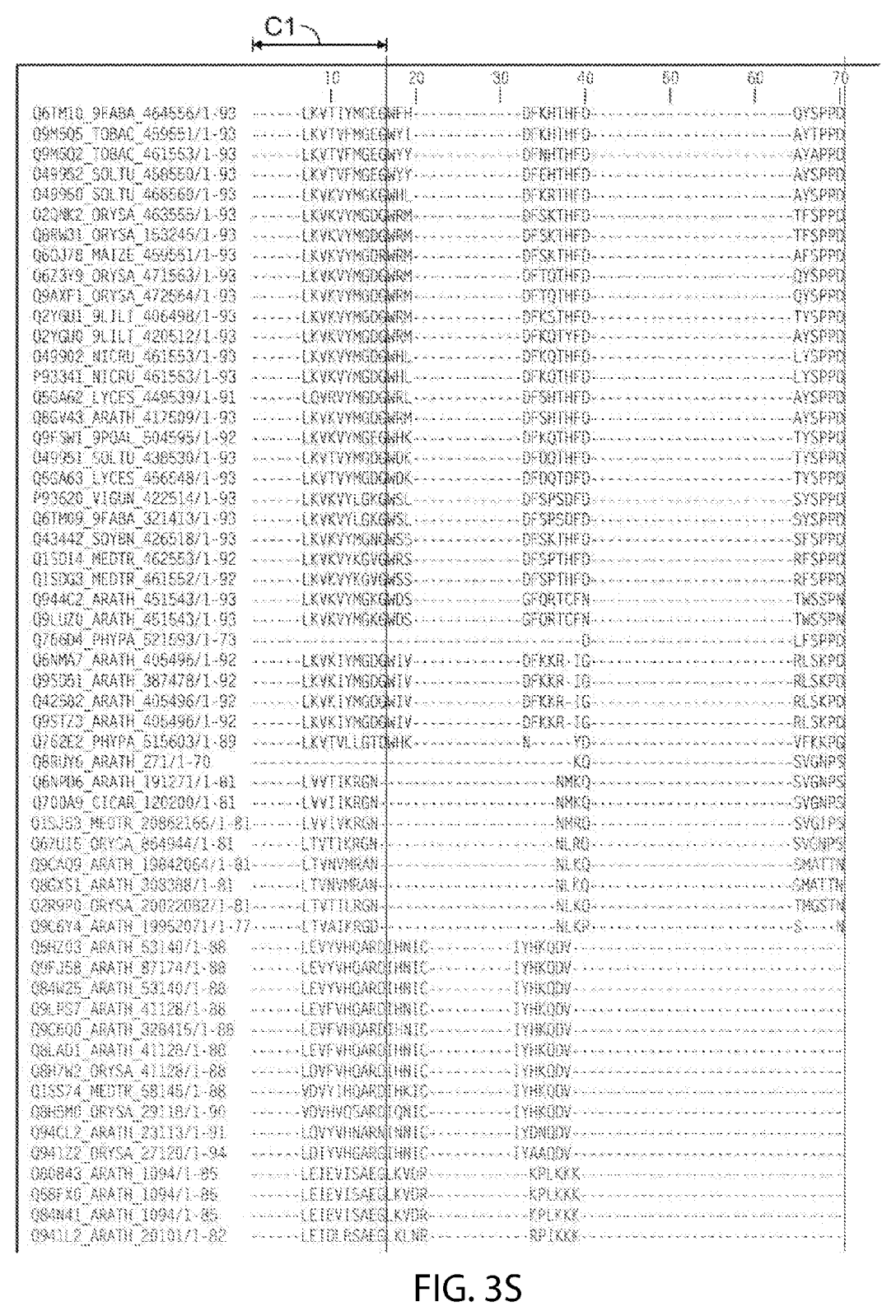
Figure 3T:
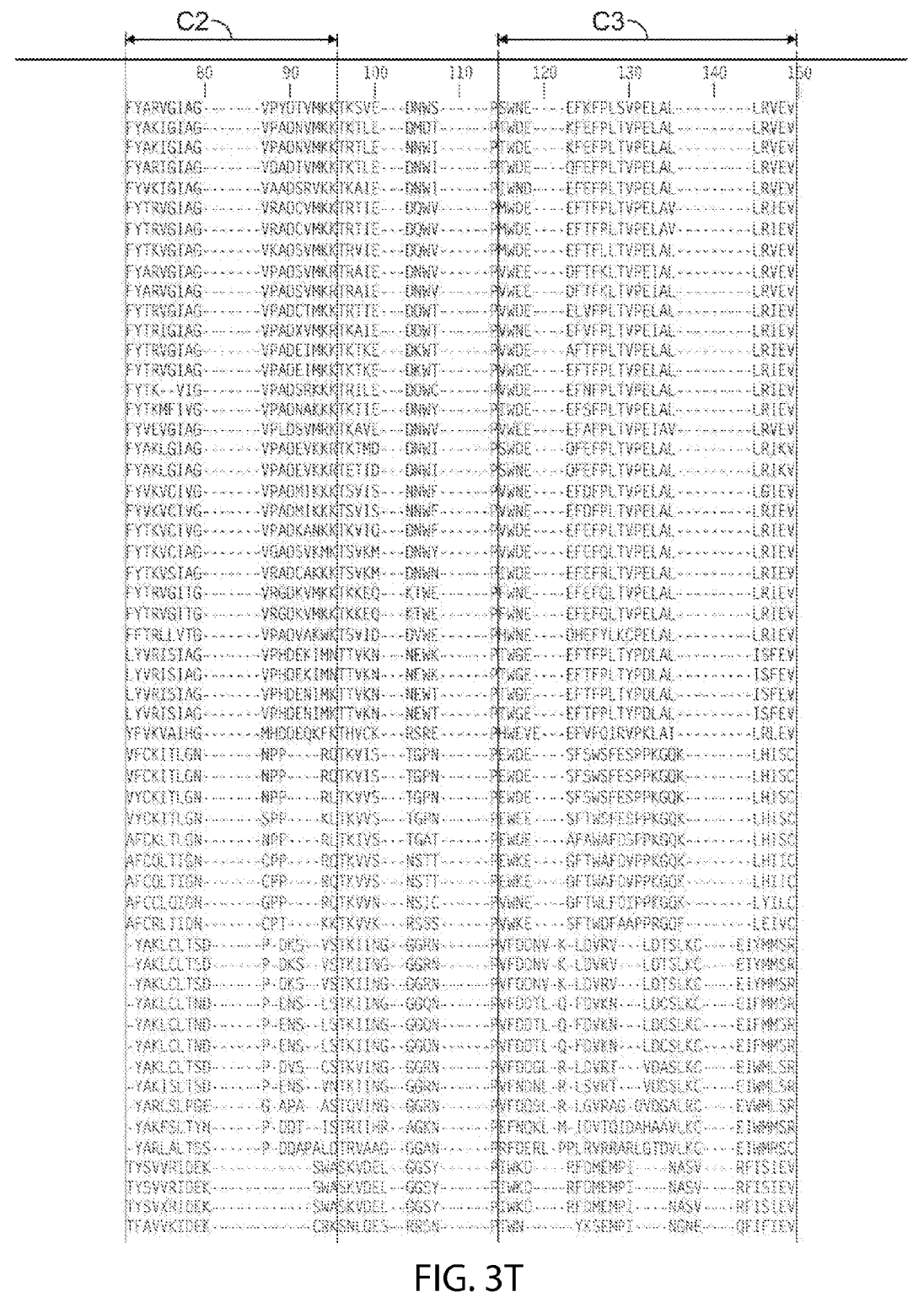
Figure 3U:
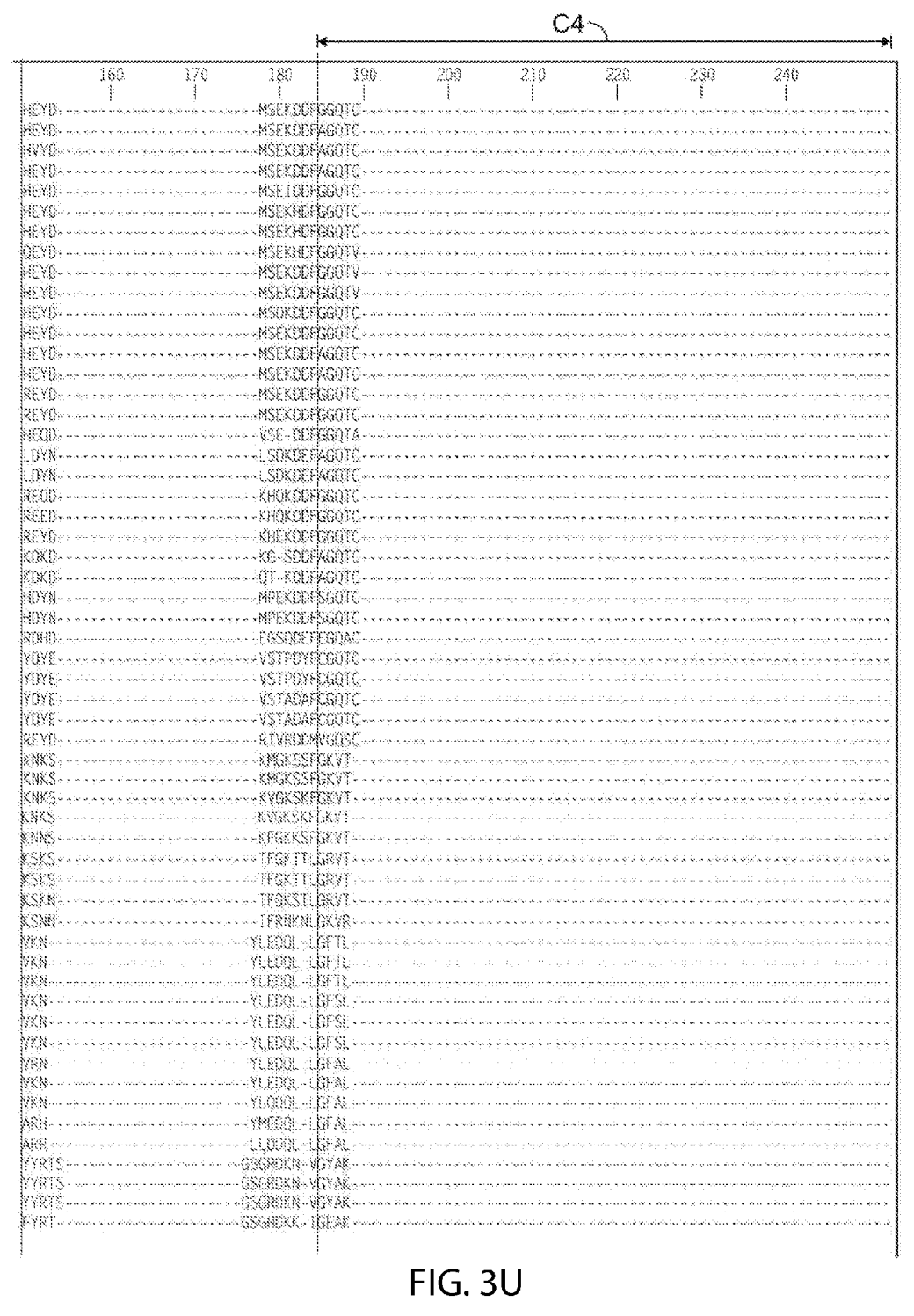
Figure 3V:
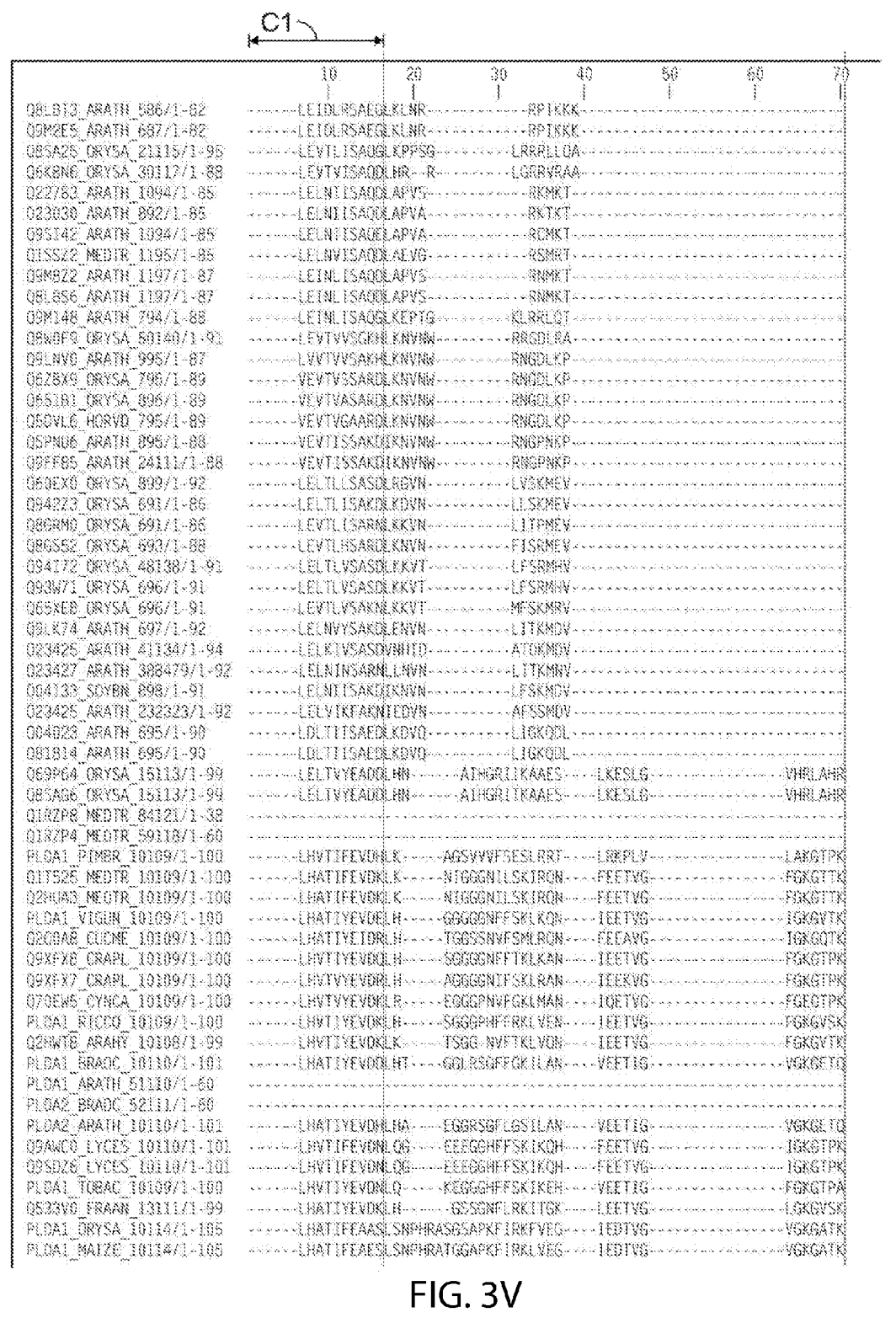
Figure 3W:
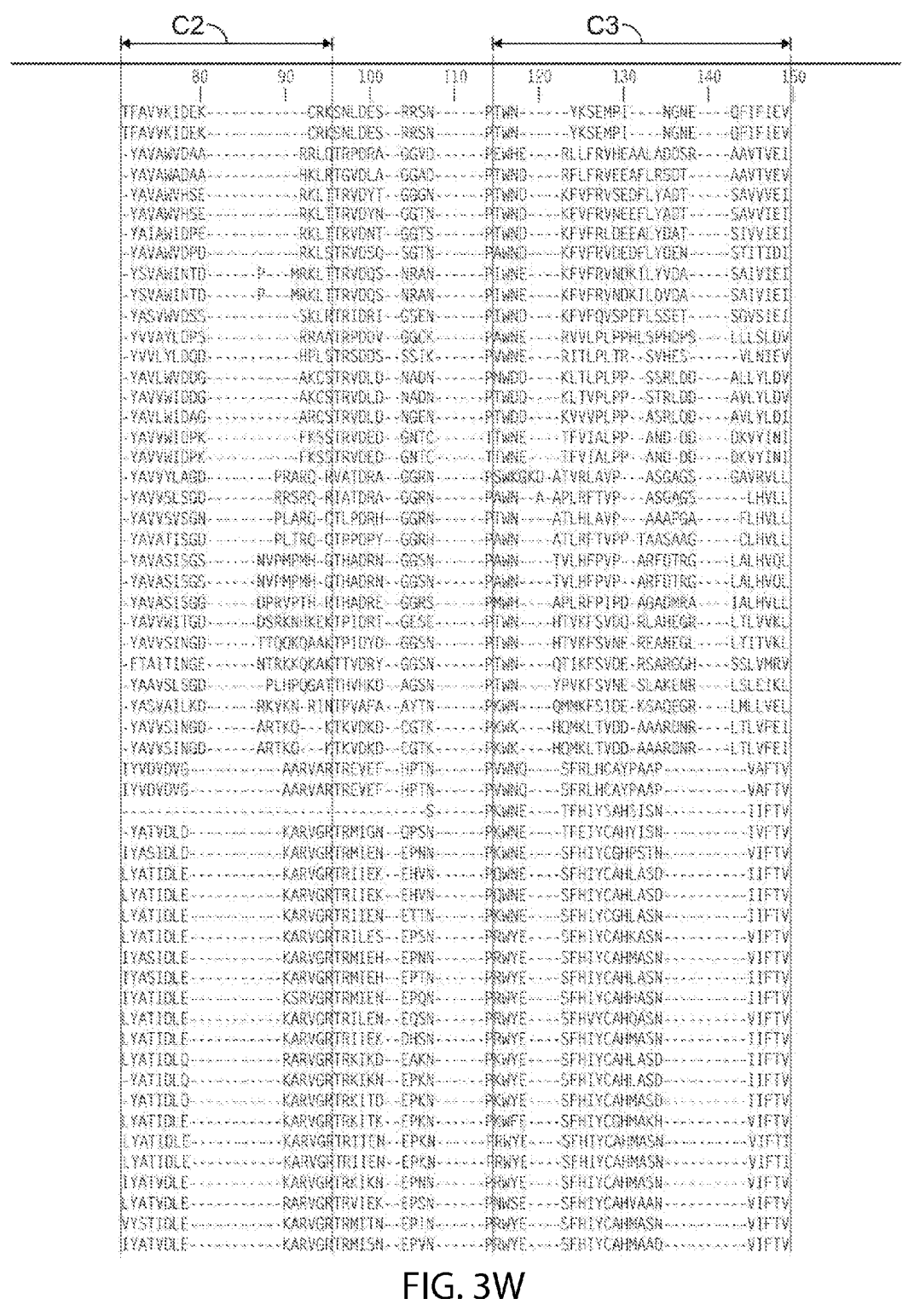
Figure 3X:
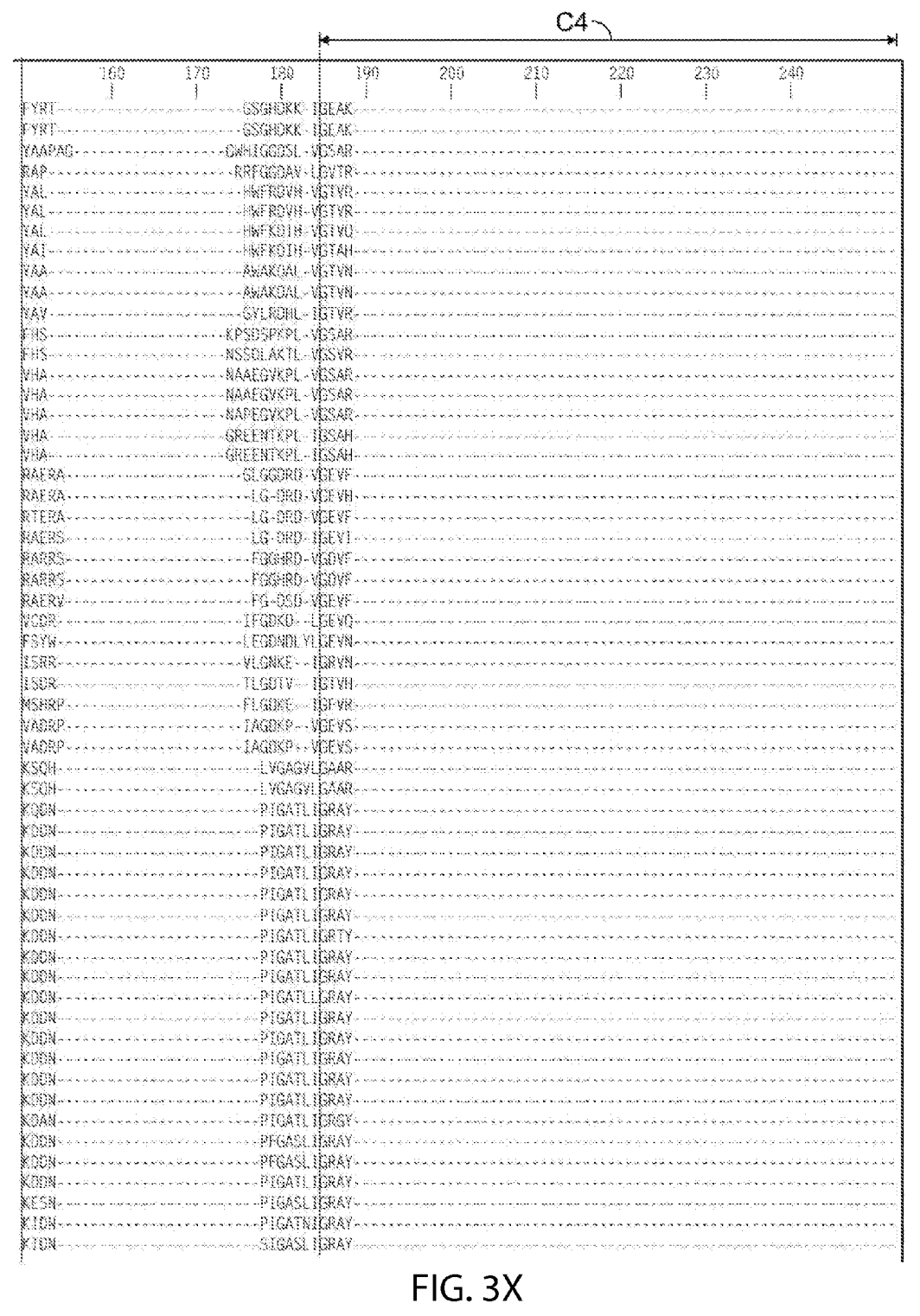
Figure 3Y:
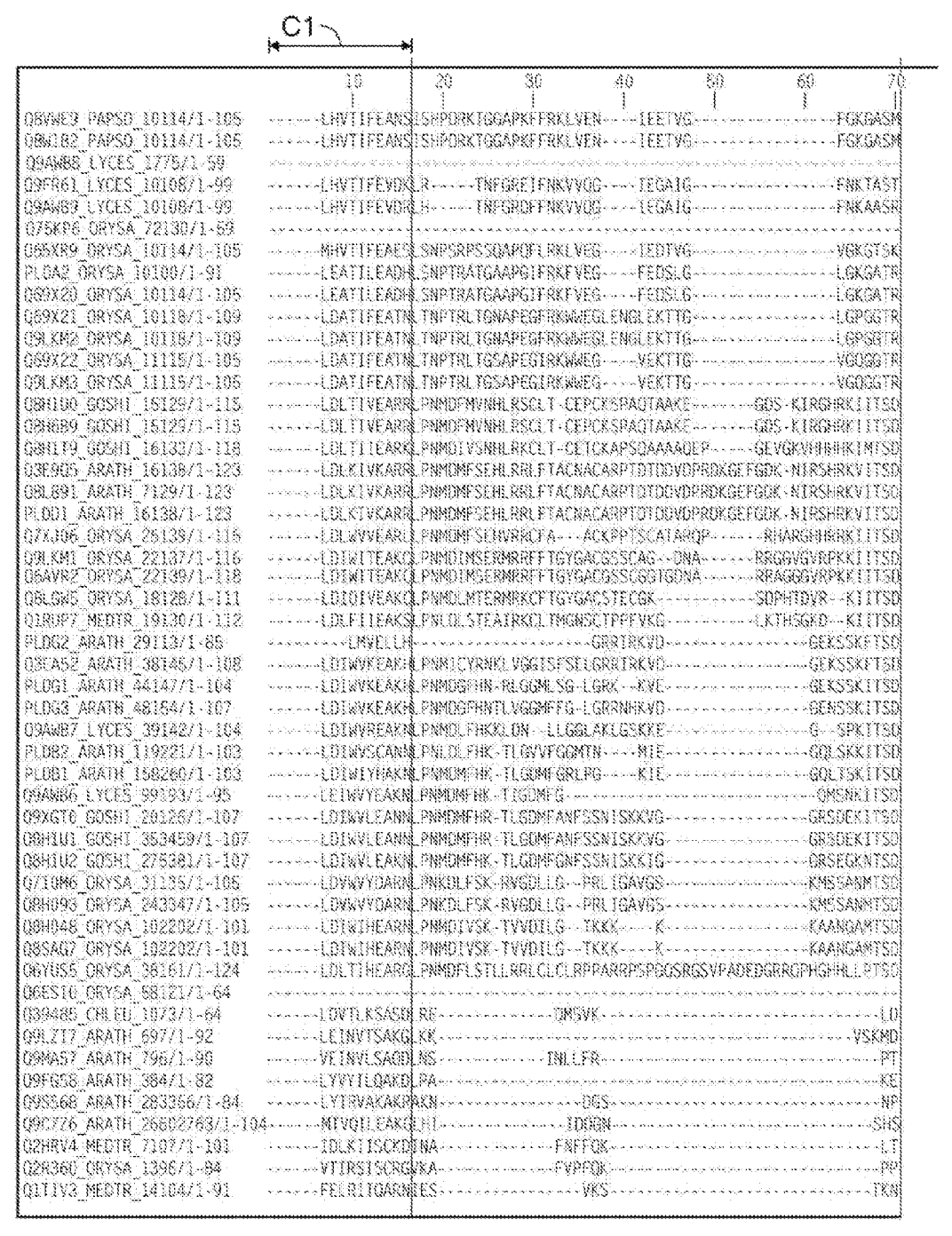

FIG. 3 is an alignment of the sequences of a number of proteins that have regions which can be used as a scaffold. These proteins are homologous to C2. The C1, C2, C3 and C4 are boxed and labeled. Sheets 1-3 show SEQ ID NOs:331-367 (i.e., Q9M366_ARATH__43120/1-78 to Q9FJG3_ARATH__325405/1-81); SEQ ID NO:131 (i.e., Reference/1-156); and SEQ ID NOs:368-384 (i.e., ERG1_ORYSA__795/1-89 to Q4JHI8_CUCMA__692/1-87). Sheets 4-6, 7-9, 10-12, 13-15, 16-18, 19-21, 22-24, and 25-27 show SEQ ID NOs:385-827.

Figure 4:
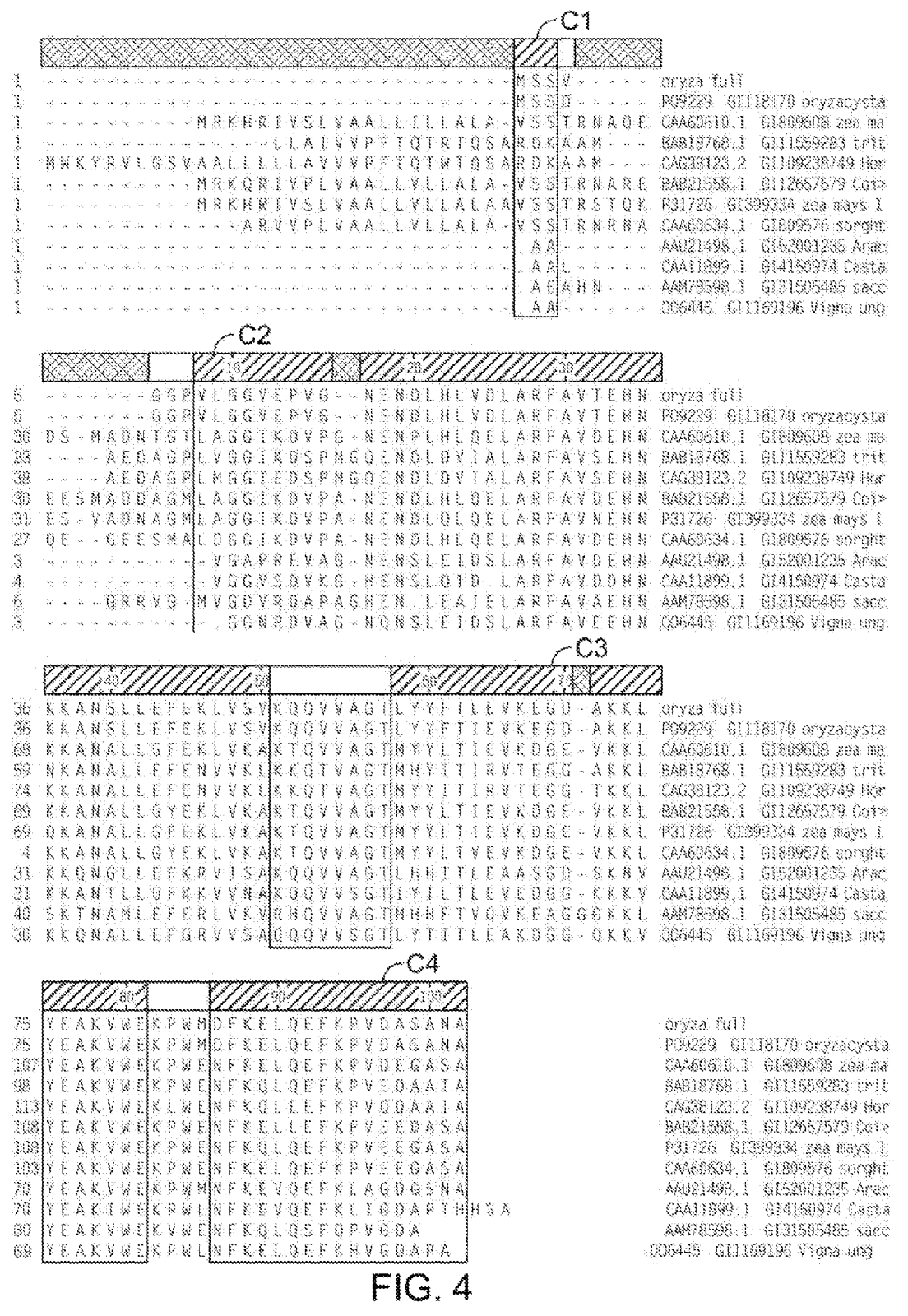

FIG. 4 is an alignment of the sequences of a number of proteins that have regions which can be used as a scaffold. The sequences shown are SEQ ID NO:130 (i.e., oryza full) and SEQ ID NOs:828-838. These proteins are homologous to oryzacystatin. The C1, C2, C3 and C4 are boxed and labeled.

DETAILED DESCRIPTION

Figure 1:
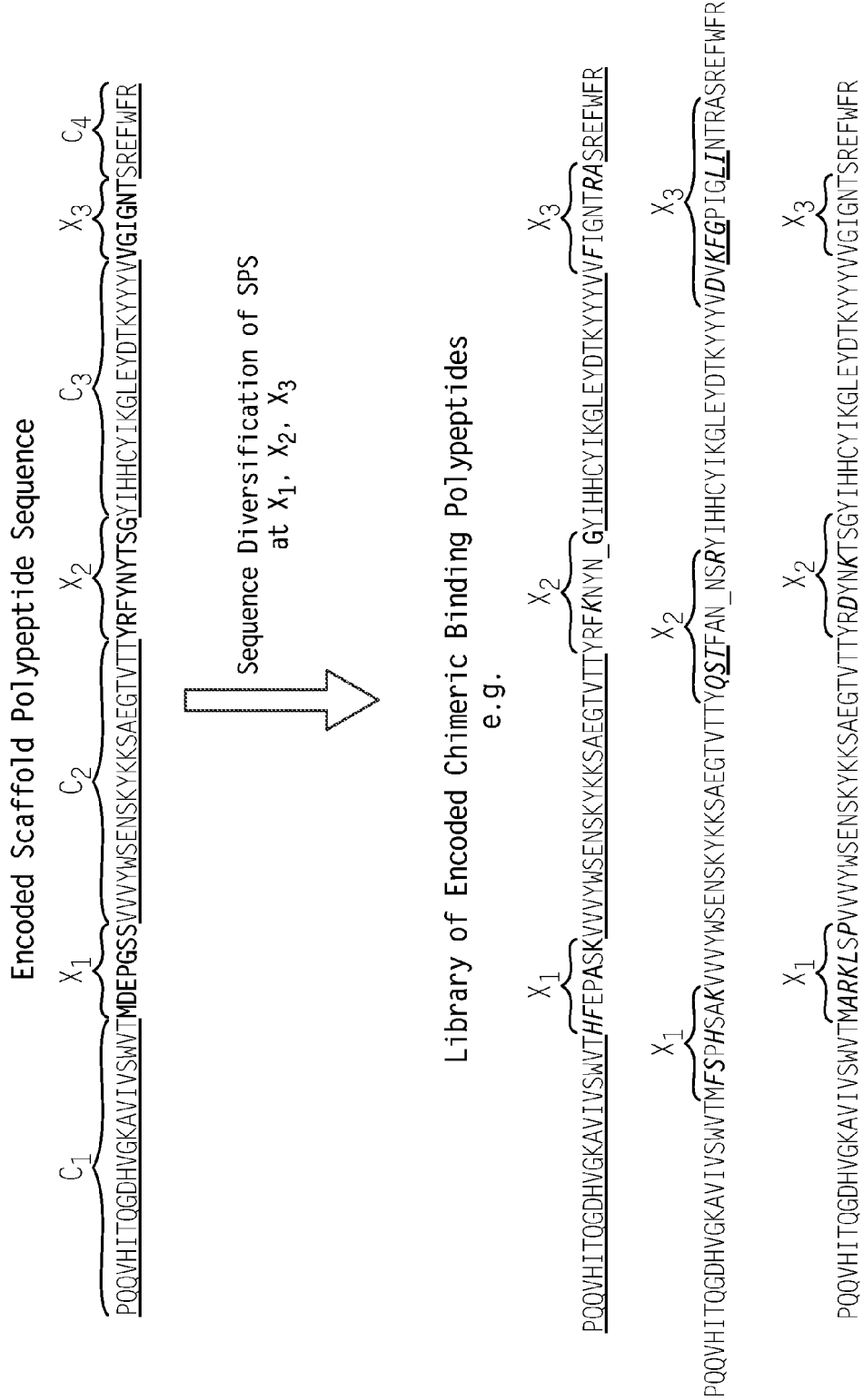
FIG. 1 is a schematic representation depicting the generation of a library of nucleic acids encoding chimeric binding polypeptides by diversifying subsequences within an encoded polypeptide scaffold sequence. The encoded scaffold polypeptide sequence is designated as SEQ ID NO:124. The encoded chimeric binding polypeptides included in the library are SEQ ID NOs:844, 845, and 846, respectively (i.e., from top to bottom).

Diverse libraries of nucleic acids (e.g., cDNA libraries) encoding plant chimeric binding polypeptides, as well as methods for generating them are described below. The amino acid sequences of the library of encoded plant chimeric binding proteins are derived from a scaffold polypeptide sequence that includes subsequences to be varied. The varied subsequences correspond to putative binding domains of the plant chimeric binding proteins, and are highly heterogeneous in the library of plant chimeric binding proteins. In contrast, the sequence of the encoded chimeric binding proteins outside of the varied subsequences is essentially the same as the parent scaffold polypeptide sequence and highly homogeneous throughout the library of encoded plant chimeric binding proteins. Thus, libraries of plant chimeric binding proteins can serve as a universal molecular recognition library platform for selection of specialized binding proteins for expression in transgenic plants. Libraries of plant chimeric binding proteins can be expressed by transfected cells (i.e., as expression libraries) and tested for interaction with a molecular target of interest. For example, expression libraries can be screened to identify polypeptides that bind with high specificity and affinity to polypeptides expressed by plant pests, including nematodes. Ultimately, individual chimeric binding proteins with desired target binding properties can be expressed in a transgenic plant.

I. Plant Scaffold Polypeptide Sequences

A plant scaffold polypeptide sequence is an amino acid sequence based on a plant protein that is structurally tolerant of extreme sequence variation within one or more regions. The regions to be varied within the scaffold polypeptide sequence are conceptually analogous to the hypervariable regions of immunoglobulins, and form putative binding domains in a chimeric binding polypeptide. Thus, a large library of nucleic acid sequences encoding diverse plant chimeric binding polypeptides is produced by diversifying specific sequences within a scaffold polypeptide sequence, as is described in detail below.

Plant scaffold polypeptide sequences are selected to have a number of properties, e.g., they: (i) are derived from sequences that are of plant origin; (ii) encode proteins that tolerate the introduction of sequence diversity structurally; (iii) only contain disulfide bonds that do not interfere with folding of the polypeptide when expressed in a plant; (iv) express at high levels in diverse plant tissues; and (v) can be targeted to different subcellular locations (e.g., cytoplasm, mitochondria, plastid) or secreted from the cell. Based on these properties, plant scaffold polypeptide sequences permit the generation of large libraries of chimeric binding polypeptides with highly diverse binding activities. Libraries of chimeric binding polypeptides can be screened for binding to a target molecule. Chimeric binding proteins having the desired binding activity can subsequently be expressed in plants to confer input traits (e.g., pest or pathogen resistance, drought tolerance) or output traits (e.g. modified lipid composition, heavy metal binding for phytoremediation, medicinal uses). Such binding proteins can also be used in various affinity-based applications, e.g., diagnostic detection of an antigen using a sandwich ELISA; histochemical detection of antigens; generation of protein biochips; and affinity purification of antigens.

It is helpful to select the scaffold polypeptide sequence based on the sequence of a plant protein or protein domain of known three dimensional structure (see, e.g., Nygren et al. (2004) "Binding Proteins from Alternative Scaffolds," *J. of Immun. Methods* 290:3-28). However, even without experimentally determined structural data for a potential scaffold polypeptide sequence, valuable inferences can be gleaned from computational structural analysis of a candidate amino acid sequence. Useful programs for structure prediction from an amino acid sequence include, e.g., the "SCRATCH Protein Predictor" suite of programs available to the public on the world wide web at ics.uci.edu/~baldig/scratch/index. It is important that introduction of sequence variation not destabilize the known or predicted secondary structure of the scaffold polypeptide sequence. Accordingly, the known or predicted secondary structure of the scaffold polypeptide sequence informs the selection of amino acid subsequences that can be varied within a scaffold polypeptide sequence to form putative binding domains. The structural adequacy of a particular scaffold polypeptide sequence can be readily tested, e.g., by phage display expression analysis methods that are commonly known in the art. For example, a scaffold polypeptide sequence containing 0, 1, 2, 3, or more disulfide bonds can be tested for its ability to fold into a stable protein. Since proteins that do not fold properly will not be incorporated into a phage coat, they will not be displayed. Thus, without undue effort, many candidate scaffold polypeptide sequences can be rapidly screened for their ability to fold into stable proteins once expressed.

The plant scaffold polypeptide sequences can be based on the accessory domain from purple acid phosphatases (PAPs). The crystal structure of the PAP accessory domain of kidney bean, *Phaseolus vulgaris*, has been determined (Strater et al. (1995), *Science* 268(5216):1489-1492). Three exposed loops within the protein are reminiscent of the hypervariable domains found in immunoglobulins. The loops are brought together by the rigid anti-parallel β-sheet framework of the protein. The subsequences that form each loop form the putative binding domains of a chimeric binding protein derived from a PAP. These subsequences are diversified by substituting, deleting, inserting, or adding up to 10 (e.g., up to 3, 4, 6, 8) amino acids. The loops that form the putative binding domains are particularly well suited to binding target molecules containing pockets or clefts.

PAP-based scaffold polypeptide sequences take the general form:

$$C_1\text{-}X_1\text{-}C_2\text{-}X_2\text{-}C_3\text{-}X_3\text{-}C_4$$

where $C_1$, $C_2$, $C_3$, and $C_4$ correspond to "backbone" subsequences which can include some introduced variation, but are not highly diversified. On the other hand, $X_1$, $X_2$, and $X_3$ correspond to highly varied subsequences that form the putative binding domains of each PAP-based chimeric binding protein. Table 1 shows a list of suitable $C_1$-$C_4$ backbone subsequences derived from the amino acid sequences of 30 PAPs.

$C_1$, $C_2$, $C_3$, and $C_4$ correspond to SEQ ID NOs: 1-30, 31-60, 61-90, and 91-120, respectively, in Table 1.

$X_1$, $X_2$, and $X_3$ can be based on naturally occurring variants of corresponding PAP sequences, e.g., those shown in Table 2 as SEQ ID NOs: 121-123. Table 2 shows the range variation at each amino acid position in subsequences corresponding, respectively, to $X_1$, $X_2$, and $X_3$, within 30 naturally occurring PAP sequences. Alternatively, the parent variable subsequences, $X_1$,-$X_3$, can be arbitrary sequences 2-20 amino acids in length.

In some implementations, $C_1$, $C_2$, $C_3$, and $C_4$ of a scaffold polypeptide sequence can be selected from multiple PAP-based scaffold polypeptide sequence sequences listed in Table 1, in any combination, e.g., $C_{1(SEQ\ ID\ NO:5)}$, $C_{2(SEQ\ ID\ NO:12)}$; $C_{3(SEQ\ ID\ NO:7)}$, and $C_{4(SEQ\ ID\ NO:19)}$; $C_{1(SEQ\ ID\ NO:5)}$, $C_{2(SEQ\ ID\ NO:12)}$, $C_{3(SEQ\ ID\ NO:5)}$, and $C_{4(SEQ\ ID\ NO:12)}$; $C_{4(SEQ\ ID\ NO:22)}$; $C_{1(SEQ\ ID\ NO:17)}$, $C_{2(SEQ\ ID\ NO:17)}$, $C_{3(SEQ\ ID\ NO:19)}$, and $C_{4(SEQ\ ID\ NO:1)}$, and so forth.

TABLE 1

| SPSs Based on the Accessory Domain of PAPs | |
|---|---|
| Seq ID | |
| | $C_1$ |
| 1 | PQQVHITQGDHVGKAVIVSWVT |
| 2 | PQQVHITQGDLVGKAVIVSWVT |
| 3 | PQQVHITQGDLVGRAMIISWVT |
| 4 | PQQVHITQGDLVGKAVIVSWVT |
| 5 | PQQVHITQGDHVGKAVIVSWVT |
| 6 | PQQVHITQGDHVGKAMIVSWVT |
| 7 | PQQVHITQGDHVGKAMIVSWVT |
| 8 | PQQVHITQGDHEGKTVIVSWVT |
| 9 | PQQVHITQGDLVGQAMIISWVT |
| 10 | PQQVHITQGDLVGQAMIISWVT |
| 11 | PQQVHITQGDHVGKAMIVSWVT |
| 12 | PQQVHITQGDLEGEAMIISWVR |
| 13 | PQQVHITQGDHVGKAVIVSWVT |
| 14 | PQQVHITQGDHVGQAMIISWVT |
| 15 | PQQVYITQGDHEGKGVIASWTT |
| 16 | PQQVHITQGDYEGKGVIISWVT |
| 17 | PQQVHITQGDLVGRAMIISWVT |
| 18 | PQQVHLTQGDHVGKGVIVSWVT |
| 19 | PQQVHITQGDVEGKAVIVSWVT |
| 20 | PQQVHVTQGNHEGNGVIISWVT |
| 21 | PQQVHVTQGNHEGNGVIISWVT |
| 22 | PQQVHITQGDYDGKAVIVSWVT |
| 23 | PQQVHITQGDHEGRSIIVSWIT |
| 24 | PQQVHITLGDQTGTAMTVSWVT |
| 25 | PQQVHITQGDYDGKAVIVSWVT |
| 26 | PQQVHITQGDYDGKAVIISWVT |
| 27 | PQQVHITQGDYDGEAVIISWVT |
| 28 | PQQVHITQGDYDGKAVIISWVT |
| 29 | PQQVHITQGDYDGKAVIISWVT |
| 30 | PQQVHITQGDYNGKAVIVSWVT |
| | $C_2$ |
| 31 | VVVYWSENSKYKKSAEGTVTT |
| 32 | EVHYWSENSDKKKIAEGKLVT |
| 33 | AVRYWSEKNGRKRIAKGKMST |
| 34 | EVHYWSENSDKKKIAEGKLVT |
| 35 | AVRYWSKNSKQKRLAKGKIVT |
| 36 | KVVYWSENSQHKKVAKGNIRT |

TABLE 1-continued

SPSs Based on the Accessory Domain of PAPs

| Seq ID | |
|---|---|
| 37 | KVVYWSENSQHKKVARGNIRT |
| 38 | TVLYWSEKSKQKNTAKGKVTT |
| 39 | QVIYWSDSSLQNFTAEGEVFT |
| 40 | QVIYWSDSSLQNFTAEGEVFT |
| 41 | TVLYWSNNSKQKNKATGAVTT |
| 42 | KVLYWIDGSNQKHSANGKITK |
| 43 | TVVYWSEKSKLKNKANGKVTT |
| 44 | EVIYWSNSSLQNFTAEGEVFT |
| 45 | SVLYWAENSNVKSSAEGFVVS |
| 46 | TVVYWAENSSVKRRADGVVVT |
| 47 | AVRYWSEKNGRKRIAKGKMST |
| 48 | KVLYWEFNSKIKQIAKGTVST |
| 49 | KVIYWKENSTKKHKAHGKTNT |
| 50 | TVRYWCENKKSRKQAEATVNT |
| 51 | TVQYWCENEKSRKQAEATVNT |
| 52 | KVQFGTSENKFQTSAEGTVSN |
| 53 | TVFYGTSENKLDQHAEGTVTM |
| 54 | TVRYGSSPEKLDRAAEGSHTR |
| 55 | EVVYGTSPNSYDHSAQGKTTN |
| 56 | HIQYGTSENKFQTSEEGTVTN |
| 57 | EVRYGLSEGKYDVTVEGTLNN |
| 58 | QVHYGAVQGKYEFVAQGTYHN |
| 59 | QVHYGAVQGKYEFVAQGTYHN |
| 60 | EVLYGKNEHQYDQRVEGTVTN |

| $C_3$ | |
|---|---|
| 61 | YIHHCYIKGLEYDTKYYYV |
| 62 | FIHHTTIRNLEYKTKYYYE |
| 63 | FIHHTTIRKLKYNTKYYYE |
| 64 | FIHHTTIRNLEYKTKYYYE |
| 65 | FIHHTTIRNLEYNTKYYYE |
| 66 | YIHHCTIRNLEYNTKYYYE |
| 67 | YIHHCTIRNLEYNTKYYYE |
| 68 | YIHHSTIRHLEFNTKYYYK |
| 69 | FIHHTTITNLEFDTYYYE |
| 70 | FIHHTTITNLEFDTYYYE |
| 71 | YIHHCIIKHLKFNTKYYYE |
| 72 | FIHHCTIRRLKHNTKYHYE |
| 73 | YIHHCNIKNLKFDTKYYYK |

| Seq ID | |
|---|---|
| 74 | FIHHTNITNLEFNTTYFYV |
| 75 | YIHHCTIKDLEFDTKYYYE |
| 76 | YIHHCTIKDLEYDTKYYYE |
| 77 | YIHHCTIKNLEYNTKYFYE |
| 78 | YIHHCTIQNLKYNTKYYYM |
| 79 | FIHHCPIRNLEYDTKYYYV |
| 80 | YIHHCLIDDLEFDTKYYYE |
| 81 | YIHHCLIDDLEFDTKYYYE |
| 82 | YVHHCLIEGLEYKTKYYYR |
| 83 | YIHHCVLTDLKYDRKYFYK |
| 84 | FIHHCTLTGLTHATKYYYA |
| 85 | YIHHCLLDKLEYDTKYYYK |
| 86 | YIHHCLIEGLEYETKYYYR |
| 87 | YIHQCLVTGLQYDTKYYYE |
| 88 | FIHHCLVSDLEHDTKYYYK |
| 89 | FIHHCLVSDLEHDTKYYYK |
| 90 | YIHHCLVDGLEYNTKYYYK |

| $C_4$ | |
|---|---|
| 91 | SREFWFR |
| 92 | TRQFWFV |
| 93 | TRRFSFI |
| 94 | TRQFWFV |
| 95 | TRQFWFV |
| 96 | TRSFWFT |
| 97 | TRSFWFT |
| 98 | ARTFWFV |
| 99 | TRQFWFI |
| 100 | TRQFWFI |
| 101 | PRTFWFV |
| 102 | VRSFWFM |
| 103 | ARTFWFT |
| 104 | TRQFWFI |
| 105 | TRKFWFV |
| 106 | KRQFWFV |
| 107 | TRQFWFT |
| 108 | RRTFWFV |
| 109 | ERKFWFF |
| 110 | SRRFWFF |

TABLE 1-continued

SPSs Based on the Accessory Domain of PAPs

| Seq ID | |
|---|---|
| 111 | SRRFWFF |
| 112 | SREFWFE |
| 113 | ARLFWFK |
| 114 | VRTFSFT |
| 115 | AREFWFH |
| 116 | SREFWFK |
| 117 | ARKFWFE |
| 118 | SREFWFV |
| 119 | SREFWFV |
| 120 | AREFWFE |

TABLE 2

Naturally Occurring Residue Variation in PAP
Subsequences Corresponding to $X_1$, $X_2$, and $X_3$
(SEQ ID NOs: 121-123)

| $X_1$ (SEQ ID NO: 121) Position | | | | | | | $X_2$ (SEQ ID NO: 122) Position | | | | | | | | | $X_3$ (SEQ ID NO: 123) Position | | | | | |
|---|---|---|---|---|---|---|---|---|---|---|---|---|---|---|---|---|---|---|---|---|---|
| a | b | c | d | e | f | g | a | b | c | d | e | f | g | h | i | a | b | c | d | e | f |
| M | D | E | P | G | S | S | Y | K | Y | Y | N | Y | T | S | G | V | G | L | R | N | T |
| V | E | A | K |   | P | N | R | F | F | T |   | S |   |   | P | I | E | I | G |   | H |
| E | N | K | L |   | K | K | T |   | H | K |   | N |   |   |   | L |   | V | E |   | D |
| P | V | D |   |   |   | T | F |   |   | D |   | K |   |   |   | M |   | E | D |   | Q |
| Q | S |   | H |   |   |   |   |   |   | E |   | E |   |   |   |   |   | T |   |   | K |
| T | I |   | T |   |   |   |   |   |   |   |   |   |   |   |   |   |   | S |   |   | S |
| A | A |   |   |   |   |   |   |   |   |   |   |   |   |   |   |   |   | E |   |   | E |
| F |   |   |   |   |   |   |   |   |   |   |   |   |   |   |   |   |   | F |   |   |   |
|   |   |   |   |   |   |   |   |   |   |   |   |   |   |   |   |   |   | K |   |   |   |

After diversification of the above-listed subsequences of the scaffold polypeptide sequence, the diversified $X_1'$, $X_2'$, and $X_3'$ subsequences are highly heterogeneous within the library of encoded plant chimeric binding polypeptides, and can each contain up to 10 (e.g., 8, 6, 4, 3) single amino acid substitutions, deletions, insertions, or additions with respect to SEQ ID NOs: 121-123 listed in Tables 1, respectively (see, e.g., FIG. 1). For example, the length of the amino acid sequences corresponding to regions $X_1$, $X_2$, or $X_3$ can be unaltered, shortened, or lengthened relative to SEQ ID NOs: 121-123.

The regions outside of the putative binding domains are referred to as "backbone" regions (i.e., $C_1$, $C_2$, $C_3$, and $C_4$). Unlike the amino acid sequences for $X_1$, $X_2$, and $X_3$, the amino acid sequences of the backbone regions are generally not substantially diversified within the library of encoded chimeric binding proteins, although some sequence variation in these regions within the library is permissible. The backbone regions of a plant scaffold polypeptide sequence can be at least 70% (i.e., 80, 85, 90, 95, 98, or 100%) identical to any of SEQ ID NOs: 1-120. Alternatively, the backbone regions can contain up to 30 (i.e., 28, 26, 24, 22, 20, 18, 17, 16, 15, 14, 13, 12, 11, 10, 9, 8, 7, 6, 5, 4, 3, 2, or 1) single amino acid substitutions, deletions, insertions or additions. For example, $C_1$, $C_2$, $C_3$, and $C_4$ can each include 0, 1, 2, 3, 4, or 5 or more single amino acid changes. If amino acid substitutions are to be introduced into the backbone regions, it is preferable to make conservative substitutions. A conservative substitution is one that preserves the substitutes an amino acid with one that has similar chemical properties (e.g., substitution of a polar amino acid such as serine with another polar amino acid such as threonine).

In one embodiment, the plant scaffold polypeptide sequence is one of SEQ ID NOs: 124-126 shown below. Sequences corresponding to $X_1$, $X_2$, and $X_3$ are in bold and underlined.

SEQ ID NO: 124
PQQVHITQGDHVGKAVIVSWVTMDEPGSSVVVYWSENSKYKKSAEGTVTT

YRFYNYTSGYIHHCYIKGLEYDTKYYYVVGIGNTSREFWFR

SEQ ID NO: 125
PQQVHITQGDLVGKAVIVSWVTVDEPGSSEVHYWSENSDKKKIAEGKLVT

YRFFNYSSGFIHHTTIRNLEYKTKYYYEVGLGNTTRQFWFV

SEQ ID NO: 126
PQQVHITQGDLVGRAMIISWVTMDEPGSSAVRYWSEKNGRKRIAKGKMST

YRFFNYSSGFIHHTTIRKLKYNTKYYYEVGLRNTTRRFSFI

In other embodiments, a plant scaffold polypeptide sequence is based on the amino acid sequence of plant proteins that have ankyrin-like repeats Ankryin-like repeats are small turn-helix-helix (THH) repeats consisting of approximately 33 amino acids. The number of THH repeats within a scaffold polypeptide sequence can vary from 2 to 20. The putative binding sites within the THH repeats are typically non-contiguous, but clustered on the same side of the protein of which they are a part.

A plant THH repeat-containing scaffold polypeptide sequence can have an amino acid sequence that is based on any of SEQ ID NOs: 127-129 listed below. High levels of amino acid sequence variation are introduced at the bolded/underlined residues. The plant THH repeat-containing scaffold polypeptide sequences can contain substitutions of up to 3 amino acids or a deletion in the place of the amino acids corresponding to residues 12-13, 33, 35-36, 38, 46-47, 66, 68-69, 71, 79-80, 99, 101-102, 104, and 112-113 (residues in bold and underlined) of SEQ ID NOs: 127-129.

SEQ ID NO: 127

GDDLGKKLHLAASRGHLEIVRVLVEAGADVNALDKFGRTALHIAASRGHL

EVVKLLLEAGADVNALDKFGRTALHLAASRGHLEVVKLLLEAGADVNALD

KFGDTALHVSIDNGNEDIAEILQ

SEQ ID NO: 128

GDDLGKKLHLAASRGHLEIVRVLVEAGADVNALDKFGRTPLHIAASKGNE

QVVKLLLEAGADPNALDKFGRTPLHIAASKGNEQVVKLLLEAGADPNAQD

KFGDTALHVSIDNGNEDIAEILQ

SEQ ID NO: 129

GSDLGKKLLEAARAGQDDEVRILMANGADVNALDKFGRTPLHIAASKGNE

QVVKLLLEAGADPNALDKFGRTPLHIAASKGNEQVVKLLLEAGADPNAQD

KFGKTAFDISIDNGNEDLAEILQ

The sequence of the scaffold polypeptide sequences can be at least 70% (i.e., 80, 85, 90, 95, 98, or 100%) identical to the sequence outside of the foregoing amino acid positions (in bold) of SEQ ID NOS: 127-129. Alternatively, the sequence of the scaffold polypeptide sequences outside of the foregoing amino acid positions (in bold) of SEQ ID NOS:127-129 can contain up to 30 (i.e., 28, 26, 24, 22, 20, 18, 17, 16, 15, 14, 13, 12, 11, 10, 9, 8, 7, 6, 5, 4, 3, 2, or 1) single amino acid substitutions, deletions, insertions or additions. In some cases it can be desirable to include additional repeating units. SEQ ID NOs: 127-129 have an amino-terminal cap, two internal repeats and a carboxy-terminal cap. It might be desirable to have 1-6 internal repeats. The amino-terminal cap sequence is aa 1-33. The first internal repeat is 34-66 and the second internal repeat is 67-99. The carboxy-terminal cap sequence is aa 100-123. The first or the second internal repeats or both can be independently repeated 1, 2, 3, 4, 5 or 6 times.

The putative binding sites are formed by amino acid side chains protruding from the rigid secondary structure formed by the scaffold polypeptide sequence. These proteins may typically form a larger, flatter binding surface and are particularly useful for binding to targets that do not have deep clefts or pockets.

Another suitable scaffold can be based on oryzacystatin (*J Biol Chem* 262:16793 (1987); *Biochemistry* 39:14753 (2000)), a member of the cystatin/Papain Family (Pfam Identifier PF00031) that is identified as a cysteine proteinase inhibitor of rice. The sequence of oryzacystatin is depicted below. A scaffold having the amino acid sequence C1-X1-C2-X2-C3-X3-C4 where each of X1, X2, X3 and X4 is a variable region and C1, C2, C3 and C4 are the backbone regions can be created based on oryzacystatin.

(SEQ ID NO: 130)

MSSVGGPVLGGVEPVGNENDLHLVDLARFAVTEHNKKANSLLEFEKLVSV

KQQVVAGTLYYFTLEVKEGDAKKLYEAKVWEKPWMDFKELQEFKPVDASA

NA

C1-MSS (aa 1-3 of SEQ ID NO: 130)

X1-VGGP (aa 4-7 of SEQ ID NO: 130)

C2-VLGGVEPVGNENDLHLVDLARFAVTEHNKKANSLLEFEKLVSV (aa 8-50 of SEQ ID NO: 130)

X2-KQQVVAGT (aa 51-58 of SEQ ID NO: 130)

C3-LYYFTLEVKEGDAKKLYEAKVWE (aa 59-81 of SEQ ID NO: 130)

X3-KPWM (aa 82-85 of SEQ ID NO: 130)

C4-DFKELQEFKPVDASANA (aa 86-102 of SEQ ID NO: 130)

Figure 2A:
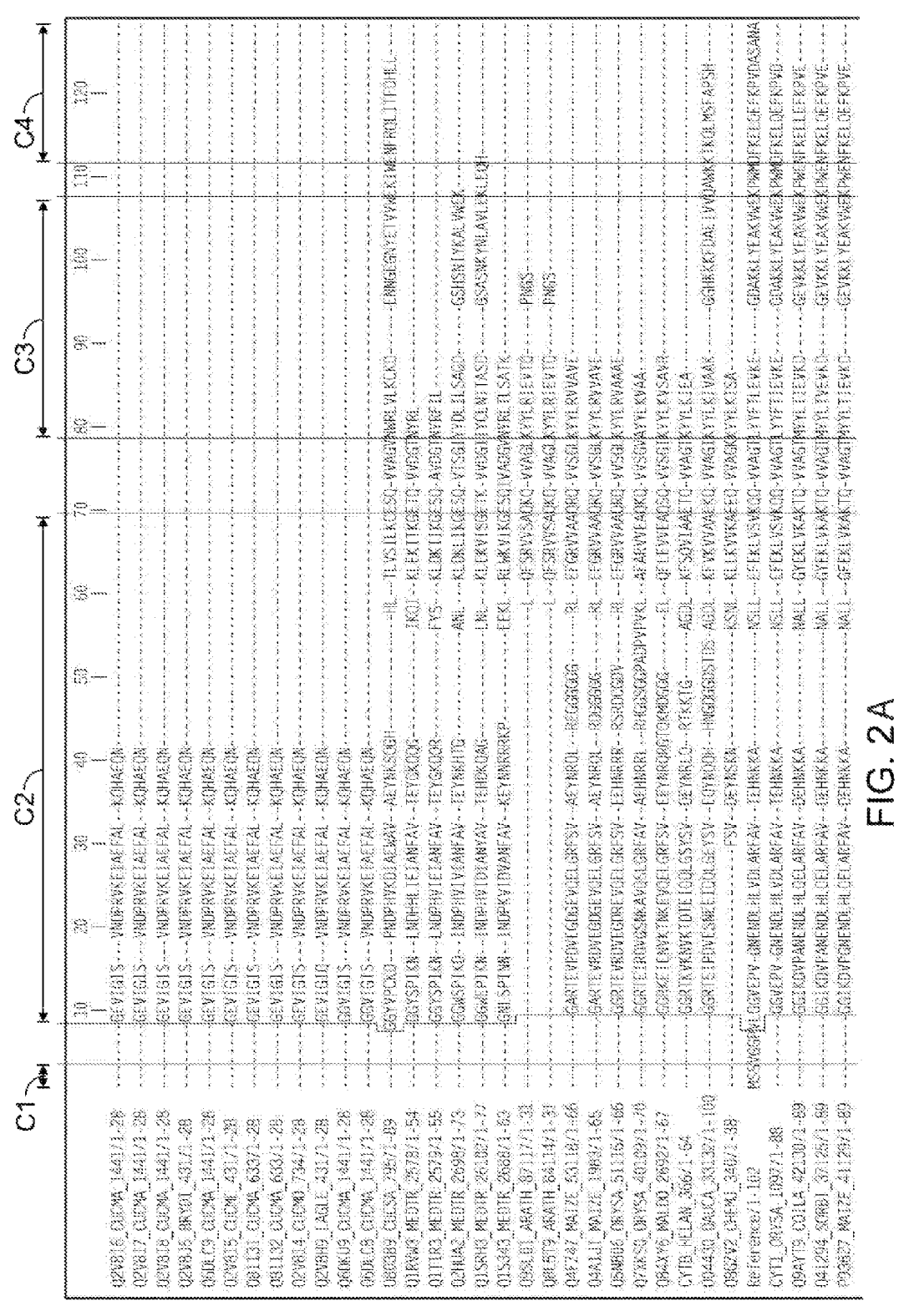
Figure 2C:
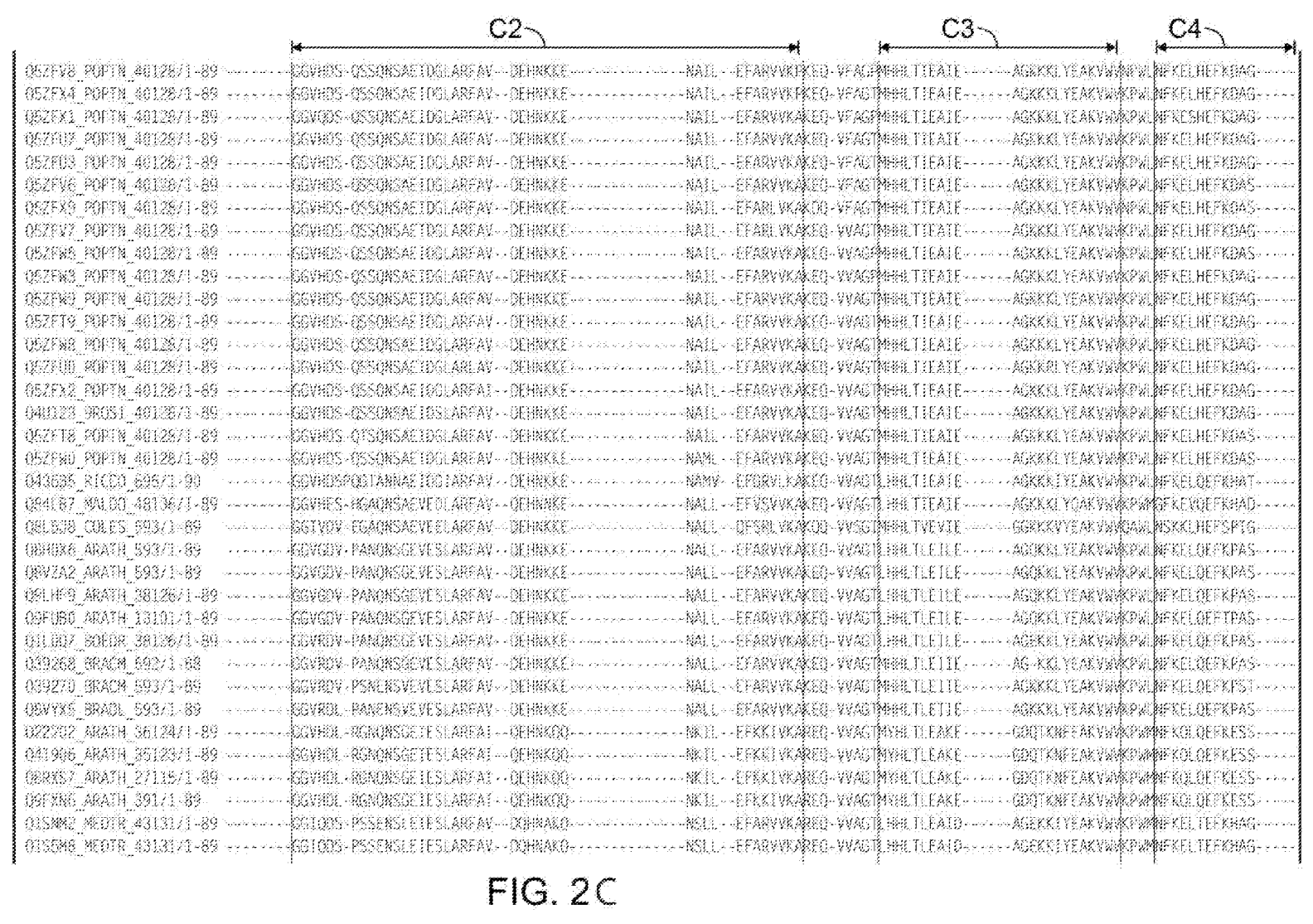
Figure 2D:
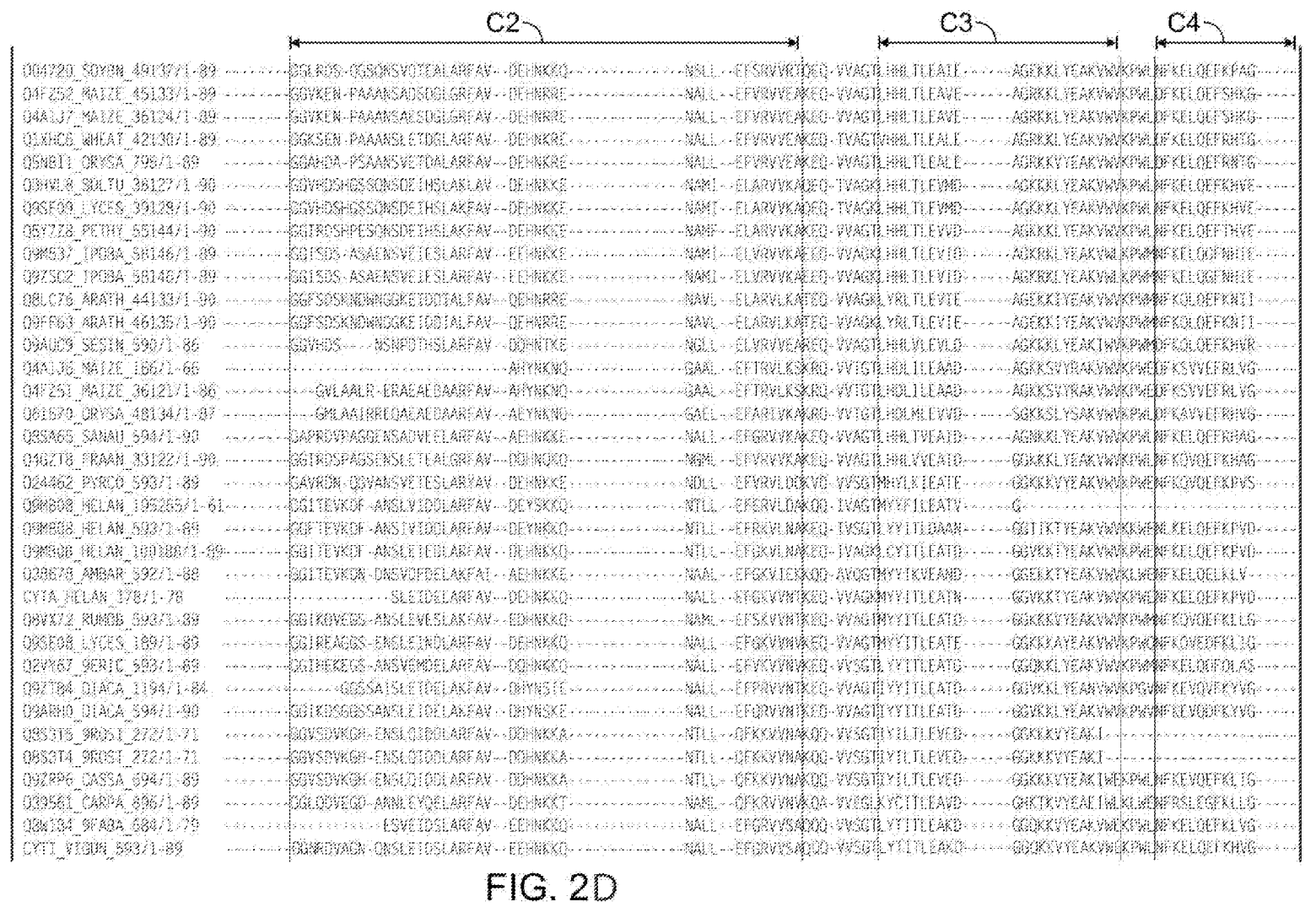
Figure 2E:
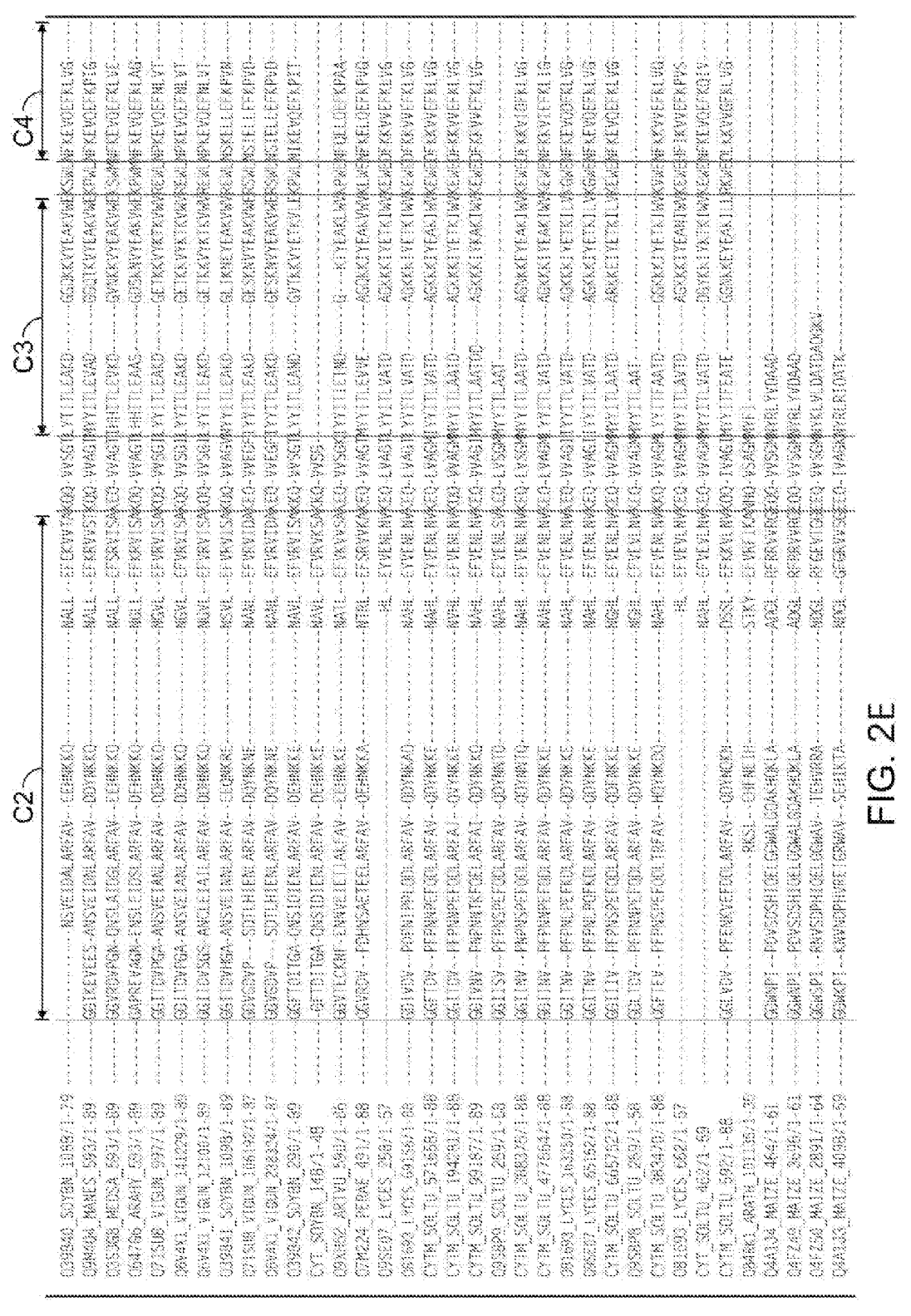
Figure 2F:
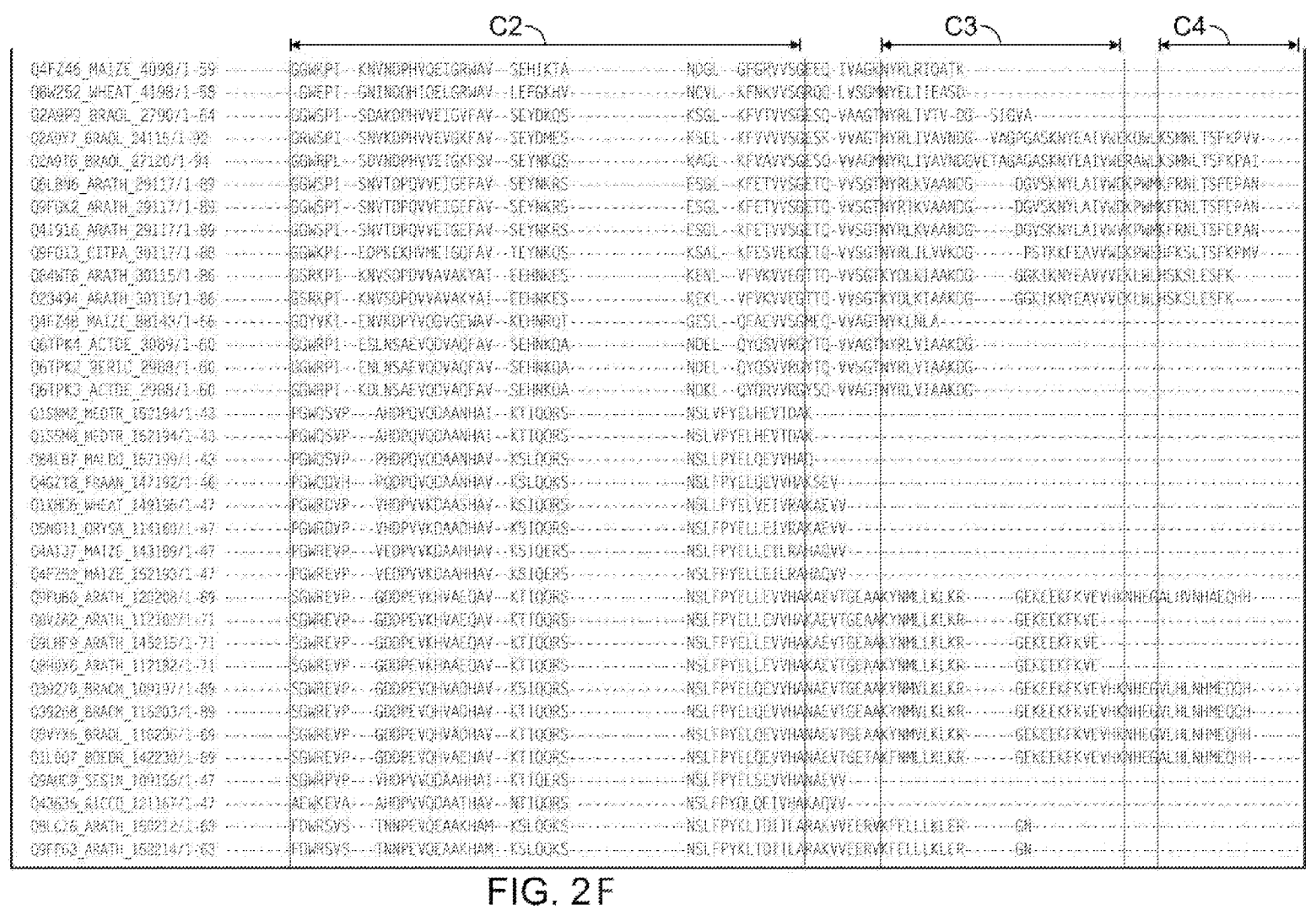

FIG. 2 depicts the sequences of a large number of plant proteins aligned with oryzacystatin. Examples of suitable C1-C4 regions are indicated. FIG. 4 depicts the sequences of a small number of plant proteins aligned with oryzacystatin. Examples of suitable C1-C4 regions are indicated. In general, X1 can be a sequence of 2-20 random amino acids (e.g., 3 amino acids). X2 can be a sequence of 2-20 random amino acids (e.g., 4 amino acids). X3 can be a sequence of 2-20 random amino acids (e.g., 4 amino acids).

Yet another suitable can be based on the C2 protein of rice (Biochemistry 42:11625 (2003)), a member of the C2 domain family (Pfam Identifier PF00168) that is thought to be be involved in plant defense signaling systems. The sequence of rice C2 is depicted below. A scaffold having the amino acid sequence C1-X1-C2-X2-C3-X3-C4 where each of X1, X2, X3 and X4 is a variable region and C1, C2, C3 and C4 are the backbone regions can be created based on rice C2.

(SEQ ID NO: 131)

MAGSGVLEVHLVDAKGLTGNDFLGKIDPYVVVQYRSQERKSSVARDQGKN

PSWNEVFKFQINSTAATGQHKLFLRLMDHDTFSRDDFLGEATINVTDLIS

LGMEHGTWEMSESKHRVVLADKTYHGEIRVSLTFTASAKAQDHAEQVGGW

AHSFRQ

C1-MAGSGVLEVHLVDAKG (aa 1-16 of SEQ ID NO: 131)

X1-LTGNDFLGKID (aa 17-27 of SEQ ID NO: 131)

C2-PYVVVQYRSQERK (aa 28-40 of SEQ ID NO: 131)

X2-SSVARDQGKNP (aa 41-51 of SEQ ID NO: 131)

C3-SWNEVFKFQINSTAATGQHKLFLRL (aa 52-76 of SEQ ID NO: 131)

X3- MDHDTFSRDDFL (aa 77-88 of SEQ ID NO: 131)

C4-

GEATINVTDLISLGMEHGTWEMSESKHRVVLADKTYHGEIRVSLTFTASA

KAQDHAEQVGGWAHSFRQ (aa 89-156 of SEQ ID NO: 131)

FIG. 3 depicts the sequences of a large number of plant proteins aligned with rice C2. Examples of suitable C1-C4 regions are indicated. FIG. 4 depicts the sequences of a small number of plant proteins aligned with oryzacystatin.

Examples of suitable C1-C4 regions are indicated. In general, X1 can be a sequence of 2-20 random amino acids (e.g., 11 amino acids). X2 can be a sequence of 2-20 random amino acids (e.g., 11 amino acids). X3 can be a sequence of 2-20 random amino acids (e.g., 12 amino acids).

The following sections disclose methods for generating libraries of nucleic acids encoding chimeric binding proteins based on plant scaffold polypeptide sequences.

II. Generation of Nucleic Acid Libraries Based on a Plant Scaffold Polypeptide Sequence A large library of nucleic acid sequence variants encoding the plant scaffold polypeptide sequence is created based on one or more plant scaffold polypeptide sequences. The library of $10^{12}$, acids encodes at least 5 (e.g., 1,000, $10^5$, $10^6$, $10^7$, $10^9$, $10^{12}$, $10^{15}$ or more) different chimeric binding protein sequences. It is recognized that not every member of a library generated by the methods described herein will encode a unique amino acid sequence. Nevertheless, it is desirable that at least 10% (e.g., 25%, 30%, 40%, 50%, 60%, 70%, 75%, or 90%) of the encoded chimeric binding proteins represented in the library be unique.

Prior to diversifying a plant scaffold polypeptide sequence, it may be useful to estimate computationally the expected sequence diversity to be generated with a given set of sequence variation parameters. A method for estimating sequence diversity is described, e.g., in Volles et al. (2005), 33 (11): 3667-3677. For example, the number of different sequences expected in a library of nucleic acids generated by PCR can be estimated based on the mutation frequency of the mutagenic polymerase used for the amplification. Useful algorithms for estimating sequence diversity in randomized protein-encoding libraries can also be found on the world wide web, e.g., at guinevere.otago.ac.nz/mlrgd/STATS/index.

Libraries of nucleic acids encoding plant chimeric binding proteins can be generated by a number of known methodologies. Sequence diversity is introduced into a plant scaffold polypeptide sequence by substitution, deletion, insertion, or addition of amino acids at the highly variable positions of a scaffold polypeptide sequence as described above. Since the set of 20 amino acids that are genetically encoded in plants have somewhat redundant chemical and structural properties, a subset of amino acids (e.g., a subset of 4 types of amino acids) that encompasses this structural diversity can be adopted for substitutions. For example, amino acids to be used for substitution or insertion can be selected to include an acidic amino acid, a neutral amino acid, an aliphatic amino acid, and an aromatic amino acid (see Table 3). For example, the amino acids used for substitution could be limited to aspartate, serine, alanine, and tyrosine. Limiting the redundancy of amino acid substitutions will increase the overall structural and binding diversity of the library of chimeric binding proteins.

The library of nucleic acids can be generated in vitro by assembly of sets of oligonucleotides with overlapping complementary sequences. First, a scaffold polypeptide sequence is selected that is to be encoded by sets of assembled oligonucleotides. The sequences to be encoded in the variable regions of a given scaffold polypeptide sequence will include a multitude of heterogeneous sequences containing substitutions, insertions, deletions in additions in accordance with the library of chimeric binding polypeptides to be generated as described above. The scaffold polypeptide sequences to be encoded can include the $C_1$-$C_4$ subsequences corresponding to any of SEQ ID NOs:1-30, 31-60, 61-90, and 91-120, respectively.

One set of oligonucleotides encodes regions of the plant scaffold polypeptide sequence where diversity is to be introduced (e.g., at $X_1$, $X_2$, and $X_3$). In contrast, regions of the scaffold polypeptide sequence in which little or no variation is to be introduced (e.g., in backbone domains of PAP scaffold polypeptide sequences) are encoded by a set of oligonucleotides encoding amino acid sequences with no less than 70% (i.e., 75%, 80%, 85%, 90%, 95%, or 100%) identity to any one of the above-mentioned scaffold polypeptide sequences. The details of this method are described, e.g., in U.S. Pat. No. 6,521,453, hereby incorporated by reference.

Sequence-varied oligonucleotides used to generate libraries of nucleic acids are typically synthesized chemically according to the solid phase phosphoramidite triester method described by Beaucage and Caruthers (1981), Tetrahedron Letts., 22 (20):1859-1862, e.g., using an automated synthesizer, as described in Needham-VanDevanter et al. (1984) Nucleic Acids Res., 12:6159-6168. A wide variety of equipment is commercially available for automated oligonucleotide synthesis. Multi-nucleotide synthesis approaches (e.g., tri-nucleotide synthesis), as discussed, supra, are also useful.

Nucleic acids can be custom ordered from a variety of commercial sources, such as Sigma-Genosys (at sigma-genosys.com/oligo.asp); The Midland Certified Reagent Company (mcrc@oligos.com), The Great American Gene Company (at genco.com), ExpressGen Inc. (at expressgen.com), Operon Technologies Inc. (Alameda, Calif.) and many others.

The oligonucleotides can have a codon use optimized for expression in a particular cell type (e.g., in a plant cell, a mammalian cell, a yeast cell, or a bacterial cell). Codon usage frequency tables are publicly available, e.g., on the world wide web at kazusa.or.jp/codon. Codon biasing can be used to optimize expression in a cell or on the surface of a cell in which binding of a plant chimeric binding protein is to be assessed, and can also be used to optimize expression of the chimeric binding protein in a transgenic organism of commercial interest (e.g., a transgenic plant). In general, codons with a usage frequency of less than 10% are not used. Before synthesis oligonucleotide sequences are checked for potentially problematic sequences, e.g, restriction sites useful for subcloning, potential plant splice acceptor or donor sites (see,

TABLE 3

Chemical Properties of Amino Acids Genetically Encoded in Plants

| Acidic | Neutral | Aliphatic | Aromatic | Basic |
|---|---|---|---|---|
| Aspartate, Glutamate, | Asparagine, Cysteine Glutamine, Methionine, Proline, Serine, Threonine, | Alanine, Glycine, Isoleucine, Leucine, Valine | Histidine, Phenylalanine, Tryptophan, Tyrosine | Arginine, Lysine | e.g., cbs.dtu.dk/services/FeatureExtract/), potential mRNA destabilization sequences (e.g., "ATTTA"), and stretches of more than four occurrences of the same nucleotide. Potentially problematic sequences are changed accordingly.

Populations of oligonucleotides are synthesized that encode amino acid variations in the putative binding regions of the selected scaffold polypeptide sequence (e.g., in regions $X_1$, $X_2$, and $X_3$ of a PAP scaffold polypeptide sequence).

Preferably, all of the oligonucleotides of a selected length (e.g., about 10, 12, 15, 20, 30, 40, 50, 60, 70, 80, 90, or 100 or more nucleotides) that correspond to regions where sequence diversity is to be introduced in the scaffold polypeptide sequence encode all possible amino acid variations from a diverse set of amino acids as described above. This includes N oligonucleotides per N sequence variations, where N is the number of different sequences at a locus. The N oligonucleotides are identical in sequence, except for the nucleotide(s) encoding the variant amino acid(s). In generating the sequence-varied oligonucleotides, it can be advantageous to utilize parallel or pooled synthesis strategies in which a single synthesis reaction or set of reagents is used to make common portions of each oligonucleotide. This can be performed e.g., by well-known solid-phase nucleic acid synthesis techniques, or, e.g., utilizing array-based oligonucleotide synthetic methods (see e.g., Fodor et al. (1991) Science, 251: 767-777; Fodor (1997) "Genes, Chips and the Human Genome" FASEB Journal. 11:121-121; Fodor (1997) "Massively Parallel Genomics" Science. 277:393-395; and Chee et al. (1996) "Accessing Genetic Information with High-Density DNA Arrays" Science 274:610-614).

In typical synthesis strategies the oligonucleotides have at least about 10 bases of sequence identity to either side of a region of variance to ensure reasonably efficient recombination. However, flanking regions with identical bases can have fewer identical bases (e.g., 4, 5, 6, 7, 8, or 9) and can, of course, have larger regions of identity (e.g., 11, 12, 13, 14, 15, 16, 17, 18, 19, 20, 25, 30, 50, or more).

The oligonucleotides to be assembled together are incubated to allow hybridization between oligonucleotides containing overlapping complementary sequences. Each set of hybridizing overlapping oligonucleotides thereby forms a contiguous nucleic acid interrupted by small gaps. These small gaps can be filled to form full length sequences using any of a variety of polymerase-mediated reassembly methods, e.g., as described herein and as known to one of skill. The greatest sequence diversity is introduced in oligonucleotides encoding the plant scaffold polypeptide sequence putative binding regions and residues. However, oligonucleotides encoding specific sequence variations can be "spiked" in the recombination mixture at any selected concentration, thus causing preferential incorporation of desirable modifications into the encoded plant chimeric binding proteins in regions outside of the putative binding domains.

For example, during oligonucleotide elongation, hybridized oligonucleotides are incubated in the presence of a nucleic acid polymerase, e.g., Taq, Klenow, or the like, and dNTP's (i.e., dATP, dCTP, dGTP and dTTP). If regions of sequence identity are large, Taq or other high-temperature polymerase can be used with a hybridization temperature of between about room temperature (i.e., about 25° C.) and, e.g., about 65° C. If the areas of identity are small, Klenow, Taq or polymerases can be used with a hybridization temperature of below room temperature. The polymerase can be added to the assembly reaction prior to, simultaneously with, or after hybridization of the oligonucleotides. Afterwards, the resulting elongated double-stranded nucleic acid sequences are denatured, hybridized, and elongated again. This cycle can be repeated for any desired number of times. The cycle is repeated e.g., from about 2 to about 100 times.

Optionally, after multiple cycles of combinatorial nucleic acid assembly, the resulting products can be amplified, e.g., by standard polymerase chain reaction (PCR). A portion of the volume of the above-described assembly reaction is incubated with unique forward and reverse primers that hybridize universally to the ends of the nucleic acids, as well as dNTPs and a suitable polymerase (e.g., pfu polymerase). The PCR reaction is then carried out for about 10 to 40 cycles.

To determine the extent of oligonucleotide incorporation any approach which distinguishes similar nucleic acids can be used. For example, the nucleic acids can be cloned and sequenced, or amplified (in vitro or by cloning, e.g., into a standard cloning or expression vector) and cleaved with a restriction enzyme which specifically recognizes a particular oligonucleotide sequence variant.

It is useful to include rare restriction sites (e.g., Not I) in the 5' ends of the 5' and 3' most primers used either in the assembly or PCR reactions. Inclusion of restriction sites in these primers facilitates subcloning of the nucleic acids into a vector by restriction digestion and subsequent ligation. Alternatively, the assembly reaction or PCR products can also be subcloned, without being restriction digested, using standard methods, e.g.,"TA" cloning.

Other methods for introducing diversity into a plant scaffold polypeptide sequence can also be used. For example, a scaffold polypeptide sequence can be encoded in a nucleic acid template, e.g., a plasmid contruct. Alternatively, a PCR product, mRNA or genomic DNA from an appropriate plant species such as soybean may also serve as a template encoding a plant scaffold polypeptide sequence. One or more scaffold polypeptide sequence subsequences to be diversified (e.g., the $X_2$ region of a PAP scaffold polypeptide sequence) can be diversified during or after amplification from the scaffold polypeptide sequence nucleic acid template by any of a number of error-prone PCR methods. Error-prone PCR methods can be divided into (a) methods that reduce the fidelity of the polymerase by unbalancing nucleotides concentrations and/or adding of chemical compounds such as manganese chloride (see, e.g., Lin-Goerke et al. (1997) *Biotechniques,* 23, 409-412), (b) methods that employ nucleotide analogs (see, e.g., U.S. Pat. No. 6,153,745), (c) methods that utilize 'mutagenic' polymerases (see, e.g., Cline, J. and Hogrefe, H. H. (2000) *Strategies* (Stratagene Newsletter), 13, 157-161 and (d) combined methods (see, e.g., Xu, H., Petersen, E. I., Petersen, S. B. and el-Gewely, M. R. (1999) *Biotechniques,* 27, 1102-1108. Other PCR-based mutagenesis methods include those, e.g., described by Osuna J, Yanez J, Soberon X, and Gaytan P. (2004), *Nucleic Acids Res.* 2004, 32 (17):e136 and Wong T S, Tee K L, Hauer B, and Schwaneberg, Nucleic Acids Res. 2004 Feb. 10; 32 (3):e26), and others known in the art.

After generating a population of sequence variants, these can be substituted into the appropriate region of a chosen plant scaffold polypeptide sequence nucleic acid (e.g., a plasmid containing a scaffold polypeptide sequence) by subcloning which thereby effectively acts as a vector for the library of diversified sequences.

Yet another approach to mutagenizing specific plant scaffold polypeptide sequence regions is the use of a mutagenic *E. coli* strain (see, e.g., Wu et al. (1999), *Plant Mol. Biol.,* 39 (2):381-386). A nucleic acid vector containing a target sequence to be mutated is introduced into the mutator strain, which is then propagated. Error-prone DNA replication in the mutator *E. coli* strain introduces mutations into the introduced target sequence. The population of altered target sequences is then recovered and subcloned into the appropriate position of a nucleic acid encoding the selected plant scaffold polypeptide sequence to generate a diverse library of nucleic acids encoding plant chimeric binding proteins.

III. Expression And Screening of Plant Chimeric Binding Proteins

The library of nucleic acids based on a plant scaffold polypeptide sequence and encoding plant chimeric binding polypeptides are subcloned into an expression vector and introduced into a biological replication system to generate an expression library. The expression library can be propagated and screened to identify plant chimeric binding proteins that bind a target molecule (TM) of interest (e.g., a nematode, insect, fungal, viral or plant protein).

The biological replication system on which screening of plant chimeric binding proteins will be practiced should be capable of growth in a suitable environment, after selection for binding to a target. Alternatively, the nucleic acid encoding the selected plant chimeric binding protein can be isolated by in vitro amplification. During at least part of the growth of the biological replication system, the increase in number is preferably approximately exponential with respect to time. The frequency of library members that exhibits the desired binding properties may be quite low, for example, one in $10^6$ or less.

Biological replication systems can be bacterial DNA viruses, vegetative bacterial cells, bacterial spores. Eukaryotic cells (e.g., yeast cells) can also be used as a biological replication system.

In a particularly useful embodiment, a chimeric binding protein-phage coat protein fusion is encoded in a phagemid construct. The phagemid constructs are transformed into host bacteria, which are subsequently infected with a helper phage that expresses wild type coat proteins. The resulting phage progeny have protein coats that include both fusion protein and wild-type coat proteins. This approach has the advantage that phage viability is greater compared to viability of phage that have exclusively chimeric binding protein-coat fusion proteins. Phagemid-based display library construction and screening kits are commercially available, e.g., the EZnet™ Phage Display cDNA Library Construction Kit and Screening Kit (Maxim Biotech, Inc., San Francisco, Calif.).

Nonetheless, a strain of any living cell or virus is potentially useful if the strain can be: 1) genetically altered with reasonable facility to encode a plant chimeric binding protein, 2) maintained and amplified in culture, 3) manipulated to display the potential binding protein domain where it can interact with the target material, and 4) selected while retaining the genetic information encoding the expressed plant chimeric binding protein in recoverable form. Preferably, the biological replication system remains viable after affinity-based selection.

When the biological replication system is a bacterial cell or a phage which is assembled in the periplasm, the expression vector for display of the plant chimeric binding protein encodes the chimeric binding protein itself fused to two additional components. The first component is a secretion signal which directs the initial expression product to the inner membrane of the cell (a host cell when the package is a phage). This secretion signal is cleaved off by a signal peptidase to yield a processed, mature, plant chimeric binding protein. The second component is an outer surface transport signal which directs the biological replication system to assemble the processed protein into its outer surface. This outer surface transport signal can be derived from a surface protein native to the biological replication system (e.g., the M13 phage coat protein gIII).

For example, the expression vector comprises a DNA encoding a plant chimeric binding protein operably linked to a signal sequence (e.g., the signal sequences of the bacterial phoA or bla genes or the signal sequence of M13 phage gene III) and to DNA encoding a coat protein (e.g., the M13 gene III or gene VIII proteins) of a filamentous phage (e.g., M13). The expression product is transported to the inner membrane (lipid bilayer) of the host cell, whereupon the signal peptide is cleaved off to leave a processed hybrid protein. The C-terminus of the coat protein-like component of this hybrid protein is trapped in the lipid bilayer, so that the hybrid protein does not escape into the periplasmic space. As the single-stranded DNA of the nascent phage particle passes into the periplasmic space, it collects both wild-type coat protein and the hybrid protein from the lipid bilayer. The hybrid protein is thus packaged into the surface sheath of the filamentous phage, leaving the plant chimeric binding protein exposed on its outer surface. Thus, the filamentous phage, not the host bacterial cell, is the biological replication system in this embodiment. If a secretion signal is necessary for the display of the plant chimeric binding protein, a "secretion-permissive" bacterial strain can be used for growth of the filamentous phage biological replication system.

It is unnecessary to use an inner membrane secretion signal when the biological replication system is a bacterial spore, or a phage whose coat is assembled intracellularly. In these cases, the display means is merely the outer surface transport signal, typically a derivative of a spore or phage coat protein.

Filamentous phage in general are attractive as biological replication systems for display of plant chimeric binding proteins, and M13 in particular, is especially attractive because: 1) the 3D structure of the virion is known; 2) the processing of the coat protein is well understood; 3) the genome is expandable; 4) the genome is small; 5) the sequence of the genome is known; 6) the virion is physically resistant to shear, heat, cold, urea, guanidinium C1, low pH, and high salt; 7) the phage is a sequencing vector so that sequencing is especially easy; 8) antibiotic-resistance genes have been cloned into the genome; 9) It is easily cultured and stored, with no unusual or expensive media requirements for the infected cells, 10) it has a high burst size, each infected cell yielding 100 to 1000 M13 progeny after infection; and 11) it is easily harvested and concentrated by standard methods.

For example, when the biological replication system is M13 the gene III or the gene VIII proteins can be used as an outer surface targeting signal. Alternatively, the proteins from genes VI, VII, and IX may also be used.

The encoded plant chimeric binding protein can be fused to the surface targeting signal (e.g., the M13 gene III coat protein) at its carboxy or amino terminal. The fusion boundary between the plant chimeric binding protein and the targeting signal can also include a short linker sequence (e.g., up to 20 amino acids long) to avoid undesirable interactions between the chimeric binding protein and the fused targeting signal. In some embodiments it is advantageous to include within the linker sequence a specific proteolytic cleavage site. In addition, the amino terminal or carboxy terminal of the fused protein can include a short epitope tag (e.g., a hemaglutinin tag). Inclusion of a proteolytic cleavage site or a short epitope tag is particularly useful for purification of a library of chimeric binding proteins from a population of cells expressing the library. Epitope-tagged chimeric binding proteins can be conveniently purified by proteolytic cleavage of linker sequence followed by affinity chromatography utilizing an antibody or other binding agent that recognizes the epitope tag.

Many methods exist for screening phage display libraries (see, e.g., Willats (2002), *Plant Mol. Biol.*, 50:837-854). As commonly practiced, the target molecule of interest is adsorbed to a support and then exposed to solutions of phage displaying plant chimeric binding proteins. The target molecule can be immobilized by passive adsorption on a support medium, e.g, tubes, plates, columns, or magnetic beads. Generally, the adsorptive support medium is pre-blocked, e.g., with bovine serum albumin, milk, or gelatin, to reduce non-specific binding of the phage during screening. Alternatively, the target molecule can be biotinylated, so interaction between chimeric binding protein-bearing phage and the target molecule can be carried out in solution. Phage that bind to the target can then be selected using avidin or streptavidin bound to a solid substrate (e.g., beads or a column).

After phage are allowed to interact with the target molecule, non-interacting phage are removed by washing. The remaining, specifically binding phage are then eluted by one of any number of treatments including, e.g., lowering or increasing pH, application of reducing agents, or use of detergents. In one embodiment, a specific proteolytic cleavage site is introduced between the plant chimeric binding protein sequence and the phage coat protein sequence. Thus, phage elution can be accomplished simply by addition of the appropriate protease.

Eluted phage are then amplified by infection of host cells and can subsequently be re-screened by the method just outlined to reduce the number of false positive binders. During each round of phage screening, care should be taken to include growth of the phage on a solid medium rather than exclusively in a liquid medium as this minimizes loss of phage clones that grow sub-optimally.

Plant chimeric binding proteins can also be expressed and screened for binding solely in vitro using ribosomal display. An exclusively in vitro approach circumvents the requirement to introduce the library of nucleic acids encoding plant chimeric binding proteins into a biological replication system. Methods for screening polypeptides in vitro by ribosomal protein display are described in detail, e.g., in U.S. Pat. No. 6,589,741. The nucleic acids described in the section above are modified by adding a phage promoter sequence (e.g., a T7 promoter) enabling in vitro transcription, a ribosome binding sequence upstream to the start of translation of the encoded plant chimeric binding protein, and a transcription termination sequence (e.g., from phage T3). The modified library of nucleic acids is then transcribed in vitro to generate a corresponding mRNA population encoding plant chimeric binding proteins. Plant chimeric binding proteins are then expressed in vitro by translating the population of mRNA molecules devoid of stop codons in the correct reading frame in an in vitro translation system, under conditions that allow the formation of polysomes. The polysomes so formed are then brought into contact with a target molecule under conditions that allow the interaction of plant chimeric binding proteins with the target molecule. Polysomes displaying chimeric binding proteins that interact with the target molecule are then separated from non-interacting polysomes displaying no such (poly)peptides; and the mRNA associated with the interacting polysome is then amplified (e.g., by PCR) and sequenced.

Interaction of a plant chimeric binding protein with a target protein can also be detected in a genetic screen. In the screen, the target protein functions as a "bait protein" and each plant chimeric binding protein functions as a potential "prey" protein in a binding assay that utilizes a two-hybrid assay or three-hybrid assay (see, e.g., U.S. Pat. No. 5,283,317; Zervos et al. (1993) Cell 72:223-232; Madura et al. (1993) J. Biol. Chem. 268:12046-12054; Bartel et al. (1993) Biotechniques 14:920-924; Iwabuchi et al. (1993) Oncogene 8:1693-1696; Hubsman et al. (2001) Nuc. Acids Res. February 15; 29 (4):E18; and Brent WO94/10300).

A two-hybrid assay can be carried out using a target polypeptide as the bait protein. In sum, the target polypeptide is fused to the LexA DNA binding domain and used as bait. The prey is plant chimeric binding protein library cloned into the active site loop of TrxA as a fusion protein with an N-terminal nuclear localization signal, a LexA activation domain, and an epitope tag (Colas et al. 1996 Nature 380:548; and Gyuris et al. Cell 1993 75:791). Yeast cells are transformed with bait and prey genes. When the target fusion protein binds to a plant chimeric binding protein fusion protein, the LexA activation domain is brought into proximity with the LexA DNA binding domain and expression of reporter genes or selectable marker genes having an appropriately positioned LexA binding site increases. Suitable reporter genes include fluorescent proteins (e.g., EGFP), enzymes (e.g., luciferase, β-galactosidase, alkaline phosphatase, etc.) Suitable selectable marker genes include, for example, the yeast LEU2 gene.

After identification of one or more target-binding chimeric binding proteins, the isolated nucleic acids encoding the chimeric binding proteins can be mutagenized by the methods described herein, to generate small expression libraries expressing variant chimeric binding proteins. The chimeric binding protein-variant expression libraries can be screened to identify chimeric binding protein variants with improved target binding properties (e.g., increased affinity or specificity).

The following specific examples are to be construed as merely illustrative, and not limitative of the remainder of the disclosure in any way whatsoever. Without further elaboration, it is believed that one skilled in the art can, based on the description herein, utilize the present invention to its fullest extent. All publications cited herein are hereby incorporated by reference in their entirety.

EXAMPLES

Example 1

Design And Expression of Plant Scaffold Polypeptide Sequences

Several protein domain families were analyzed for their potential use as scaffolds. A search of PFAM domains (pfam.wustl.edu; see Bateman et al. (2004)), restricting the output to Viridiplantae, was conducted to limit domains only to those present in green plants. Four protein domain families were selected to develop plant universal molecular recognition libraries; the accessory domain of purple acid phosphatase (PAP), plant cystatin, plant C2 domains and the turn-helix-helix (THH) motif found in ankyrin repeat proteins.

Three purple acid phosphatase scaffolds were designed having the sequence of SEQ ID NOs:34-36. The amino acid sequence of the accessory domain from kidney bean PAP was used as a query sequence to BLAST the NCBI database. When the output was restricted to proteins found in Viridiplantae, 62 unique sequences were identified. From an alignment of these sequences, a consensus plant PAP sequence was generated (SEQ ID NO:34) by selecting the most frequent amino acid at each position in the alignment. The kidney bean (*Phaseolus vulgaris*) PAP was selected as a parental scaffold (SEQ ID NO:35), because of its known structure. A PAP from soybean, *Glycine max*, was also chosen (SEQ ID NO:36), as this species represents a common crop species in which transgenic products are generated.

A set of scaffold polypeptide sequences which contain plant ankyrin-like repeats was also designed. Ankyrin-like repeats are small turn-helix-helix (THH) motifs consisting of approximately 33 amino acids. They are common elements of proteins from all organisms and are often found in tandem arrays of 2 to 20 repeats within a protein.

Three THH scaffolds were generated. These proteins are similar in structure to GA binding protein (GABP-β). This protein consists of THH like amino and carboxy terminal caps with 3 THH internal repeats. In this protein, it is thought that the caps help stabilize the protein by shielding hydrophobic residues found in the internal repeats.

Three hundred and twelve Viridiplantae ankyrin repeats proteins found in PFAM were aligned to aid in designing plant-specific THH scaffolds. A plant consensus THH sequence was generated by selecting the most frequently occurring amino acid at each position. This sequence was termed the plant consensus internal repeat sequence. This sequence was used to search the NCBI databases by BLAST alignment to find the closest natural THH sequence found in plants. A sequence from wheat (*Triticum aestivum*) was found. The designed repeat based on *T. aestivum* contains a substitution of valine for the single cysteine occurring in the *T. aestivum* sequence. Two sets of N and C terminal caps were generated. One set consists of sequences derived from GABP-β and the second set was derived from the plant THH consensus sequence and optimized to resemble the structure of GABP-β. In particular, the N terminal cap has an extended alpha-helical structure, while the C terminal cap has a truncated helix compared to the typical THH repeat.

Three THH scaffolds were designed, one consists of plant consensus N and C caps and two plant consensus internal THH repeats (SEQ ID NO:37). Another consists of plant consensus N and C caps and two wheat internal repeats (SEQ ID NO:38) and the third consists of ankyrin like N and C caps with two wheat internal repeats (SEQ ID NO:39).

The genes encoding the plant scaffold polypeptide sequences were designed for expression testing in plants, bacteria, and on the surface of phage. Codons were selected for plant expression using a publicly available *Glycine max* codon usage table (at kazusa.or.jp/codon, codon usage tabulated from the international DNA sequence databases: status for the year 2000. Nakamura, Y, Gojobori, T and Ikemura, T (2000) *Nucl. Acids Res.* 28:292.). Codon selection was done manually with the aim for the final codon frequency to roughly reflect the natural frequency for *Glycine max*. Rarely used codons (<10% frequency) were not used. Final sequences were checked for potential problematic sequences, including removal of restriction sites needed for cloning, potential plant splice acceptor or donor sites (see website at cbs.dtu.dk/services/NetPgene/), potential mRNA destabilization sequences (ATTTA) and stretches of more than 4 occurrences of the same nucleotide. Any potential problematic sequences were altered in the genes by modifying codon usage. Since the THH sequences have 4 similar repeat sequences within each protein, steps were taken to reduce nucleotide similarity within repeats; the average repeat identity was reduced 10-15% by these means.

Seven constructs were produced using synthetic gene assembly, (three based on THH scaffold polypeptide sequences, two based on PAP scaffold polypeptide sequences, one plant cystatin and one plant C2 domain protein). The three THH scaffold polypeptide sequences were placed into a phagemid vector as fusion sequences with the gene III coat protein (gIII) at its carboxy terminus (Phage 3.2, Maxim Biotech, Inc., South San Francisco, Calif.). A 6-His tag was included at the 5' end of the gene as well as a c-Myc tag between the scaffold gene and the encoded amino terminus of gIII. The phagemid constructs were then packaged into phage particles and the phage were tested for expression and surface display of the THH scaffold. A phage ELISA using either anti-His and anti-Myc indicated that the THH scaffold proteins were expressed on the surface of phage in phage ELISAs, suggesting that all 3 THH scaffold polypeptide sequence constructs are folding and expressing well on the phage surface. The selected scaffold polypeptide sequences were then used to generate expression vectors to evaluate their expression in transgenic plants by immunoblotting.

Tobacco leaves were injected with *agrobacterium*, LB4404 transformed with THH containing plant expression vectors. Two days later, sections of leaves injected with agrobacterium were harvested, frozen on dry ice, then ground into a fine powder with a pestle. PBS containing 0.2% Tween-20 was added to the fine powder at a 1:1 weight to volume ratio and additional grinding was done. Insoluble material was removed by centrifugation and 10 ul of the remaining supernatant was loaded onto a 4-12% acrylamide SDS page gel (NuPage, Intvitrogen). Proteins were transferred to PVDF membranes. Proteins were detected using a rat anti-HA antibody (Roche) and an anti-rat HRP conjugated secondary antibody (Chemicon). HRP was detected using Amerham Lumigen reagents.

All three THH scaffold were found to be expressed, with the relative level of expression of the three scaffolds being TA-THH>CC-THH>. TC-THH.

Other Embodiments

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features. From the above description, one skilled in the art can easily ascertain the essential characteristics of the present invention, and without departing from the spirit and scope thereof, can make various changes and modifications of the invention to adapt it to various usages and conditions. Thus, other embodiments are also within the scope of the following claims.

SEQUENCE LISTING (846 sequences)

SEQ ID NO: 1 - protein, 22 aa, Phaseolus vulgaris
PQQVHITQGDHVGKAVIVSWVT

SEQ ID NO: 2 - protein, 22 aa, Phaseolus vulgaris
PQQVHITQGDLVGKAVIVSWVT

SEQ ID NO: 3 - protein, 22 aa, Phaseolus vulgaris
PQQVHITQGDLVGRAMIISWVT

SEQ ID NO: 4 - protein, 22 aa, Phaseolus vulgaris
PQQVHITQGDLVGKAVIVSWVT

SEQ ID NO: 5 - protein, 22 aa, Phaseolus vulgaris
PQQVHITQGDHVGKAVIVSWVT

SEQ ID NO: 6 - protein, 22 aa, Phaseolus vulgaris
PQQVHITQGDHVGKAMIVSWVT

SEQ ID NO: 7 - protein, 22 aa, Phaseolus vulgaris
PQQVHITQGDHVGKAMIVSWVT

SEQ ID NO: 8 - protein, 22 aa, Phaseolus vulgaris
PQQVHITQGDHEGKTVIVSWVT

SEQ ID NO: 9 - protein, 22 aa, Phaseolus vulgaris
PQQVHITQGDLVGQAMIISWVT

SEQ ID NO: 10 - protein, 22 aa, Phaseolus vulgaris
PQQVHITQGDLVGQAMIISWVT

SEQ ID NO: 11 - protein, 22 aa, Phaseolus vulgaris
PQQVHITQGDHVGKAMIVSWVT

SEQ ID NO: 12 - protein, 22 aa, Phaseolus vulgaris
PQQVHITQGDLEGEAMIISWVR

SEQ ID NO: 13 - protein, 22 aa, Phaseolus vulgaris
PQQVHITQGDHVGKAVIVSWVT

SEQ ID NO: 14 - protein, 22 aa, Phaseolus vulgaris
PQQVHITQGDHVGQAMIISWVT

SEQ ID NO: 15 - protein, 22 aa, Phaseolus vulgaris
PQQVYITQGDHEGKGVIASWTT

SEQ ID NO: 16 - protein, 22 aa, Phaseolus vulgaris
PQQVHITQGDYEGKGVIISWVT

SEQ ID NO: 17 - protein, 22 aa, Phaseolus vulgaris
PQQVHITQGDLVGRAMIISWVT

SEQ ID NO: 18 - protein, 22 aa, Phaseolus vulgaris
PQQVHLTQGDHVGKGVIVSWVT

SEQ ID NO: 19 - protein, 22 aa, Phaseolus vulgaris
PQQVHITQGDVEGKAVIVSWVT

SEQ ID NO: 20 - protein, 22 aa, Phaseolus vulgaris
PQQVHVTQGNHEGNGVIISWVT

SEQ ID NO: 21 - protein, 22 aa, Phaseolus vulgaris
PQQVHVTQGNHEGNGVIISWVT

SEQ ID NO: 22 - protein, 22 aa, Phaseolus vulgaris
PQQVHITQGDYDGKAVIVSWVT

SEQ ID NO: 23 - protein, 22 aa, Phaseolus vulgaris
PQQVHITQGDHEGRSIIVSWIT

SEQ ID NO: 24 - protein, 22 aa, Phaseolus vulgaris
PQQVHITLGDQTGTAMTVSWVT

SEQ ID NO: 25 - protein, 22 aa, Phaseolus vulgaris
PQQVHITQGDYDGKAVIVSWVT

SEQ ID NO: 26 - protein, 22 aa, Phaseolus vulgaris
PQQVHITQGDYDGKAVIISWVT

SEQ ID NO: 27 - protein, 22 aa, Phaseolus vulgaris
PQQVHITQGDYDGEAVIISWVT

SEQ ID NO: 28 - protein, 22 aa, Phaseolus vulgaris
PQQVHITQGDYDGKAVIISWVT

SEQ ID NO: 29 - protein, 22 aa, Phaseolus vulgaris
PQQVHITQGDYDGKAVIISWVT

SEQ ID NO: 30 - protein, 22 aa, Phaseolus vulgaris
PQQVHITQGDYNGKAVIVSWVT

SEQ ID NO: 31 - protein, 21 aa, Phaseolus vulgaris
VVVYWSENSKYKKSAEGTVTT

SEQ ID NO: 32 - protein, 21 aa, Phaseolus vulgaris
EVHYWSENSDKKKIAEGKLVT

SEQ ID NO: 33 - protein, 21 aa, Phaseolus vulgaris
AVRYWSEKNGRKRIAKGKMST

SEQ ID NO: 34 - protein, 21 aa, Phaseolus vulgaris
EVHYWSENSDKKKIAEGKLVT

SEQ ID NO: 35 - protein, 21 aa, Phaseolus vulgaris
AVRYWSKNSKQKRLAKGKIVT

SEQ ID NO: 36 - protein, 21 aa, Phaseolus vulgaris
KVVYWSENSQHKKVAKGNIRT

SEQ ID NO: 37 - protein, 19 aa, Phaseolus vulgaris
KVVYWSENSQHKKVRNIRT

SEQ ID NO: 38 - protein, 21 aa, Phaseolus vulgaris
TVLYWSEKSKQKNTAKGKVTT

SEQ ID NO: 39 - protein, 21 aa, Phaseolus vulgaris
QVIYWSDSSLQNFTAEGEVFT

SEQ ID NO: 40 - protein, 21 aa, Phaseolus vulgaris
QVIYWSDSSLQNFTAEGEVFT

SEQ ID NO: 41 - protein, 21 aa, Phaseolus vulgaris
TVLYWSNNSKQKNKATGAVTT

SEQ ID NO: 42 - protein, 21 aa, Phaseolus vulgaris
KVLYWIDGSNQKHSANGKITK

SEQ ID NO: 43 - protein, 21 aa, Phaseolus vulgaris
TVVYWSEKSKLKNKANGKVTT

SEQ ID NO: 44 - protein, 21 aa, Phaseolus vulgaris
EVIYWSNSSLQNFTAEGEVFT

SEQ ID NO: 45 - protein, 21 aa, Phaseolus vulgaris
SVLYWAENSNVKSSAEGFVVS

SEQ ID NO: 46 - protein, 21 aa, Phaseolus vulgaris
TVVYWAENSSVKRRADGVVVT

SEQ ID NO: 47 - protein, 21 aa, Phaseolus vulgaris
AVRYWSEKNGRKRIAKGKMST

SEQ ID NO: 48 - protein, 21 aa, Phaseolus vulgaris
KVLYWEFNSKIKQIAKGTVST

SEQ ID NO: 49 - protein, 21 aa, Phaseolus vulgaris
KVIYWKENSTKKHKAHGKTNT

SEQ ID NO: 50 - protein, 21 aa, Phaseolus vulgaris
TVRYWCENKKSRKQAEATVNT

SEQ ID NO: 51 - protein, 21 aa, Phaseolus vulgaris
TVQYWCENEKSRKQAEATVNT

SEQ ID NO: 52 - protein, 21 aa, Phaseolus vulgaris
KVQFGTSENKFQTSAEGTVSN

SEQ ID NO: 53 - protein, 21 aa, Phaseolus vulgaris
TVFYGTSENKLDQHAEGTVTM

SEQ ID NO: 54 - protein, 21 aa, Phaseolus vulgaris
TVRYGSSPEKLDRAAEGSHTR

SEQ ID NO: 55 - protein, 21 aa, Phaseolus vulgaris
EVVYGTSPNSYDHSAQGKTTN

SEQ ID NO: 56 - protein, 21 aa, Phaseolus vulgaris
HIQYGTSENKFQTSEEGTVTN

SEQ ID NO: 57 - protein, 21 aa, Phaseolus vulgaris
EVRYGLSEGKYDVTVEGTLNN

SEQ ID NO: 58 - protein, 21 aa, Phaseolus vulgaris
QVHYGAVQGKYEFVAQGTYHN

SEQ ID NO: 59 - protein, 21 aa, Phaseolus vulgaris
QVHYGAVQGKYEFVAQGTYHN

SEQ ID NO: 60 - protein, 21 aa, Phaseolus vulgaris
EVLYGKNEHQYDQRVEGTVTN

SEQ ID NO: 61 - protein, 19 aa, Phaseolus vulgaris
YIHHCYIKGLEYDTKYYYV

SEQ ID NO: 62 - protein, 19 aa, Phaseolus vulgaris
FIHHTTIRNLEYKTKYYYE

SEQ ID NO: 63 - protein, 19 aa, Phaseolus vulgaris
FIHHTTIRKLKYNTKYYYE

SEQ ID NO: 64 - protein, 19 aa, Phaseolus vulgaris
FIHHTTIRNLEYKTKYYYE

SEQ ID NO: 65 - protein, 19 aa, Phaseolus vulgaris
FIHHTTIRNLEYNTKYYYE

SEQ ID NO: 66 - protein, 19 aa, Phaseolus vulgaris
YIHHCTIRNLEYNTKYYYE

SEQ ID NO: 67 - protein, 19 aa, Phaseolus vulgaris
YIHHCTIRNLEYNTKYYYE

SEQ ID NO: 68 - protein, 19 aa, Phaseolus vulgaris
YIHHSTIRHLEFNTKYYYK

SEQ ID NO: 69 - protein, 19 aa, Phaseolus vulgaris
FIHHTTITNLEFDTTYYYE

SEQ ID NO: 70 - protein, 19 aa, Phaseolus vulgaris
FIHHTTITNLEFDTTYYYE

SEQ ID NO: 71 - protein, 19 aa, Phaseolus vulgaris
YIHHCIIKHLKFNTKYYYE

SEQ ID NO: 72 - protein, 19 aa, Phaseolus vulgaris
FIHHCTIRRLKHNTKYHYE

SEQ ID NO: 73 - protein, 19 aa, Phaseolus vulgaris
YIHHCNIKNLKFDTKYYYK

SEQ ID NO: 74 - protein, 19 aa, Phaseolus vulgaris
FIHHTNITNLEFNTTYFYV

SEQ ID NO: 75 - protein, 19 aa, Phaseolus vulgaris
YIHHCTIKDLEFDTKYYYE

SEQ ID NO: 76 - protein, 19 aa, Phaseolus vulgaris
YIHHCTIKDLEYDTKYYYE

SEQ ID NO: 77 - protein, 19 aa, Phaseolus vulgaris
YIHHCTIKNLEYNTKYFYE

SEQ ID NO: 78 - protein, 19 aa, Phaseolus vulgaris
YIHHCTIQNLKYNTKYYYM

SEQ ID NO: 79 - protein, 19 aa, Phaseolus vulgaris
FIHHCPIRNLEYDTKYYYV

SEQ ID NO: 80 - protein, 19 aa, Phaseolus vulgaris
YIHHCLIDDLEFDTKYYYE

SEQ ID NO: 81 - protein, 19 aa, Phaseolus vulgaris
YIHHCLIDDLEFDTKYYYE

SEQ ID NO: 82 - protein, 19 aa, Phaseolus vulgaris
YVHHCLIEGLEYKTKYYYR

SEQ ID NO: 83 - protein, 19 aa, Phaseolus vulgaris
YIHHCVLTDLKYDRKYFYK

SEQ ID NO: 84 - protein, 19 aa, Phaseolus vulgaris
FIHHCTLTGLTHATKYYYA

SEQ ID NO: 85 - protein, 19 aa, Phaseolus vulgaris
YIHHCLLDKLEYDTKYYYK

SEQ ID NO: 86 - protein, 19 aa, Phaseolus vulgaris
YIHHCLIEGLEYETKYYYR

SEQ ID NO: 87 - protein, 19 aa, Phaseolus vulgaris
YIHQCLVTGLQYDTKYYYE

SEQ ID NO: 88 - protein, 19 aa, Phaseolus vulgaris
FIHHCLVSDLEHDTKYYYK

SEQ ID NO: 89 - protein, 19 aa, Phaseolus vulgaris
FIHHCLVSDLEHDTKYYYK

SEQ ID NO: 90 - protein, 19 aa, Phaseolus vulgaris
YIHHCLVDGLEYNTKYYYK

SEQ ID NO: 91 - protein, 7 aa, Phaseolus vulgaris
SREFWFR

SEQ ID NO: 92 - protein, 7 aa, Phaseolus vulgaris
TRQFWFV

SEQ ID NO: 93 - protein, 7 aa, Phaseolus vulgaris
TRRFSFI

SEQ ID NO: 94 - protein, 7 aa, Phaseolus vulgaris
TRQFWFV

SEQ ID NO: 95 - protein, 7 aa, Phaseolus vulgaris
TRQFWFV

SEQ ID NO: 96 - protein, 7 aa, Phaseolus vulgaris
TRSFWFT

SEQ ID NO: 97 - protein, 7 aa, Phaseolus vulgaris
TRSFWFT

SEQ ID NO: 98 - protein, 7 aa, Phaseolus vulgaris
ARTFWFV

SEQ ID NO: 99 - protein, 7 aa, Phaseolus vulgaris
TRQFWFI

SEQ ID NO: 100 - protein, 7 aa, Phaseolus vulgaris
TRQFWFI

SEQ ID NO: 101 - protein, 7 aa, Phaseolus vulgaris
PRTFWFV

SEQ ID NO: 102 - protein, 7 aa, Phaseolus vulgaris
VRSFWFM

SEQ ID NO: 103 - protein, 7 aa, Phaseolus vulgaris
ARTFWFT

SEQ ID NO: 104 - protein, 7 aa, Phaseolus vulgaris
TRQFWFI

SEQ ID NO: 105 - protein, 7 aa, Phaseolus vulgaris
TRKFWFV

SEQ ID NO: 106 - protein, 7 aa, Phaseolus vulgaris
KRQFWFV

SEQ ID NO: 107 - protein, 7 aa, Phaseolus vulgaris
TRQFWFT

SEQ ID NO: 108 - protein, 7 aa, Phaseolus vulgaris
RRTFWFV

SEQ ID NO: 109 - protein, 7 aa, Phaseolus vulgaris
ERKFWFF

SEQ ID NO: 110 - protein, 7 aa, Phaseolus vulgaris
SRRFWFF

SEQ ID NO: 111 - protein, 7 aa, Phaseolus vulgaris
SRRFWFF

SEQ ID NO: 112 - protein, 7 aa, Phaseolus vulgaris
SREFWFE

SEQ ID NO: 113 - protein, 7 aa, Phaseolus vulgaris
ARLFWFK

SEQ ID NO: 114 - protein, 7 aa, Phaseolus vulgaris
VRTFSFT

SEQ ID NO: 115 - protein, 7 aa, Phaseolus vulgaris
AREFWFH

SEQ ID NO: 116 - protein, 7 aa, Phaseolus vulgaris
SREFWFK

SEQ ID NO: 117 - protein, 7 aa, Phaseolus vulgaris
ARKFWFE

SEQ ID NO: 118 - protein, 7 aa, Phaseolus vulgaris
SREFWFV

SEQ ID NO: 119 - protein, 7 aa, Phaseolus vulgaris
SREFWFV

SEQ ID NO: 120 - protein, 7 aa, Phaseolus vulgaris
AREFWFE

SEQ ID NO: 121 - protein, 7 aa, Artificial Sequence
  Synthetically generated peptide
  VARIANT 1: Xaa = Met, Val, Glu, Pro, Gln, Thr, Ala or  Phe
  VARIANT 2: Xaa = Asp, Glu,  Asn, Val, Ser, Ile or Ala
  VARIANT 3: Xaa = Glu, Ala, lys or Asp
  VARIANT 4: Xaa = Pro, Lys or Leu
  VARIANT 6: Xaa = Ser, Pro, Lys, His or Thr
  VARIANT (7)...(0): Xaa = Ser, Asn, Lys or Thr
XXXXGXX

SEQ ID NO: 122 - protein, 9 aa, Artificial Sequence
  Synthetically generated peptide
  VARIANT 2: Xaa = Lys, Arg, Thr or Phe
  VARIANT 3: Xaa = Tyr or Phe
  VARIANT 4: Xaa = Tyr, Phe or His
  VARIANT 5: Xaa = Asn, Thr, Lys, Asp or Glu
  VARIANT 7: Xaa = Thr, Ser, Asn, Lys or Glu
  VARIANT (9)...(0): Xaa = Gly or Pro
YXXXXYXSX

SEQ ID NO: 123 - protein, 6 aa, Artificial Sequence
  Synthetically generated peptide
  VARIANT 1: Xaa = Val, Ile, Leu or Met
  VARIANT 2: Xaa = Gly or Glu
  VARIANT 3: Xaa = Leu, Ile, Val, Glu, Thr, Ser, Glu, Phe or Lys
  VARIANT 4: Xaa = Arg, Gly, Glu or Asp
  VARIANT 5: Xaa = Asn, His, Asp, Gln, Lys, Ser or Glu
XXXXXT

SEQ ID NO: 124 - protein, 91 aa, Artificial Sequence
  Synthetically generated peptide
PQQVHITQGDHVGKAVIVSWVTMDEPGSSVVVYWSENSKYKKSAEGTVTTYRFYNYTSGYIHHCYIKGLEYDTKYYYVVGIGNTSREFWFR

SEQ ID NO: 125 - protein, 91 aa, Artificial Sequence
  Synthetically generated peptide
PQQVHITQGDLVGKAVIVSWVTVDEPGSSEVHYWSENSDKKKIAEGKLVTYRFFNYSSGFIHHTTIRNLEYKTKYYYEVGLGNTTRQFWFV

SEQ ID NO: 126 - protein, 91 aa, Artificial Sequence
  Synthetically generated peptide
PQQVHITQGDLVGRAMIISWVTMDEPGSSAVRYWSEKNGRKRIAKGKMSTYRFFNYSSGFIHHTTIRKLKYNTKYYYEVGLRNTTRRFSFI

SEQ ID NO: 127 - protein, 123 aa, Artificial Sequence
  Synthetically generated peptide
GDDLGKKLHLAASRGHLEIVRVLVEAGADVNALDKFGRTALHIAASRGHLEVVKLLLEAGADVNALDKFGRTALHLAASRGHLEVVKLLLEAGADVNALDKFGDTALHVSIDNGNEDIAEILQ

SEQ ID NO: 128 - protein, 123 aa, Artificial Sequence
  Synthetically generated peptide
GDDLGKKLHLAASRGHLEIVRVLVEAGADVNALDKFGRTPLHIAASKGNEQVVKLLLEAGADPNALDKFGRTPLHIAASKGNEQVVKLLLEAGADPNAQDKFGDTALHVSIDNGNEDIAEILQ

SEQ ID NO: 129 - protein, 123 aa, Artificial Sequence
  Synthetically generated peptide
GSDLGKKLLEAARAGQDDEVRILMANGADVNALDKFGRTPLHIAASKGNEQVVKLLLEAGADPNALDKFGRTPLHIAASKGNEQVVKLLLEAGADPNAQDKFGKTAFDISIDNGNEDLAEILQ

SEQ ID NO: 130 - protein, 102 aa, Oryza sativa
MSSVGGPVLGGVEPVGNENDLHLVDLARFAVTEHNKKANSLLEFEKLVSVKQQVVAGTLYYFTLEVKEGDAKKLYEAKVWEKPWMDFKELQEFKPVDASANA

SEQ ID NO: 131 - protein, 156 aa, Oryza sativa
MAGSGVLEVHLVDAKGLTGNDFLGKIDPYVVVQYRSQERKSSVARDQGKNPSWNEVFKFQINSTAATGQHKLFLRLMDHDTFSRDDFLGEATINVTDLISLGMEHGTWEMSESKHRVVLADKTYHGEIRVSLTFTASAKAQDHAEQVGGWAHSFRQ

SEQ ID NO: 132 - protein, 28 aa, Artificial Sequence
  Synthetically generated peptide
GEVIGISVNDPRVKEIAEFALKQHAEQN

SEQ ID NO: 133 - protein, 28 aa, Artificial Sequence
  Synthetically generated peptide
GEVIGIQVNDPRVKEIAEFALKQHAEQN

SEQ ID NO: 134 - protein, 28 aa, Artificial Sequence
  Synthetically generated peptide
GGVIGISVNDPRVKEIAEFALKQHAEQN

SEQ ID NO: 135 - protein, 89 aa, Artificial Sequence
  Synthetically generated peptide
GGYVPCKDPNDPHVKDIAEWAVAEYNKSQGHHLTLVSILKCESQVVAGVNWRLVLKCKDENNGEGNYETVVWEKIWENFRQLITFDHLL

SEQ ID NO: 136 - protein, 54 aa, Artificial Sequence
  Synthetically generated peptide
GGYSPIKNLNDHHLIEIANFAVTEYGKQQGIKQIKLEKITKGETQVVDGTNYRL

SEQ ID NO: 137 - protein, 55 aa, Artificial Sequence
  Synthetically generated peptide
GGYSPIKNLNDPHVIEIANFAVTEYGKQQRFYSKLDKIIKGESQAVDGTNYRFIL

SEQ ID NO: 138 - protein, 73 aa, Artificial Sequence
  Synthetically generated peptide
GGWSPIKDINDPHVIVIANFAVTEYNKHTGANLKLDKLIKGESQVTSGIYYDLILSAGDGSHSNIYKALVWEK

SEQ ID NO: 139 - protein, 76 aa, Artificial Sequence
  Synthetically generated peptide
GGWEPIKNINDPHVIDIANYAVTEHDKQAGLNLKLEKVISGETKVVDGIIYCLNITASDGSASNKYNLAVLEKLQH

SEQ ID NO: 140 - protein, 63 aa, Artificial Sequence
  Synthetically generated peptide
GNLSPINNINDPKVIDVANFAVKEYNNRRRKPEEKLRLWKVIKGESQIVADGVNYRLTLSATK

SEQ ID NO: 141 - protein, 31 aa, Artificial Sequence
  Synthetically generated peptide
LQFSRVVSAQKQVVAGLKYYLRIEVTQPNGS

SEQ ID NO: 142 - protein, 31 aa, Artificial Sequence; identical to SEQ ID NO: 141
  Synthetically generated peptide

SEQ ID NO: 143 - protein, 66 aa, Artificial Sequence
  Synthetically generated peptide
GARTEVPDVEGDGEVQELGRFSVAEYNRQLREGGGGGGRLEFGRVVAAQRQVVSGLKYYLRVVAVE

SEQ ID NO: 144 - protein, 65 aa, Artificial Sequence
  Synthetically generated peptide
GARTEVRDVEGDGEVQELGRFSVAEYNRQLRDGGGGGRLEFGRVVAAQRQVVSGLKYYLRVVAVE

SEQ ID NO: 145 - protein, 66 aa, Artificial Sequence
  Synthetically generated peptide
GGRTEVRDVEGDREVQELGRFSVEEHNRRRRSRDCGDVRLEFGRVVAAQRQVVSGLKYYLRVAAAE

SEQ ID NO: 146 - protein, 70 aa, Artificial Sequence
  Synthetically generated peptide
GGRTEIRDVGSNKAVQSLGRFAVAEHNRRLRHGGSGGPADPVPVKLAFARVVEAQKQVVSGVAYYLKVAA

SEQ ID NO: 147 - protein, 67 aa, Artificial Sequence
  Synthetically generated peptide
GGRKEIENVKTNKEVQELGRFSVEEYNRQRGTQKMDGGGELQFLEVVEAQSQVVSGIKYYLKVSAVR

SEQ ID NO: 148 - protein, 64 aa, Artificial Sequence
  Synthetically generated peptide
GGRTKVKNVKTDTEIQQLGSYSVDEYNRLQRTKKTGAGDLKFSQVIAAETQVVAGTKYYLKIEA

SEQ ID NO: 149 - protein, 100 aa, Artificial Sequence
  Synthetically generated peptide
GGRTEIPDVESNEEIQQLGEYSVEQYNQQHHNGDGGDSTDSAGDLKFVKVVAAEKQVVAGIKYYLKIVAAKGGHKKKFDAEIVVQAWKKTKQLMSFAPSH

SEQ ID NO: 150 - protein, 38 aa, Artificial Sequence
  Synthetically generated peptide
FSVDEYNSKNKSNLKLLKVVKAEEQVVAGKKYYLKISA

SEQ ID NO: 151 - protein, 88 aa, Artificial Sequence
  Synthetically generated peptide
GGVEPVGNENDLHLVDLARFAVTEHNKKANSLLEFEKLVSVKQQVVAGTLYYFTIEVKEGDAKKLYEAKVWEKPWMDFKELQEFKPVD

SEQ ID NO: 152 - protein, 89 aa, Artificial Sequence
  Synthetically generated peptide
GGIKDVPANENDLHLQELARFAVDEHNKKANALLGYEKLVKAKTQVVAGTMYYLTIEVKDGEVKKLYEAKVWEKPWENFKELLEFKPVE

SEQ ID NO: 153 - protein, 89 aa, Artificial Sequence
  Synthetically generated peptide
GGIKDVPANENDLHLQELARFAVDEHNKKANALLGYEKLVKAKTQVVAGTMYYLTVEVKDGEVKKLYEAKVWEKPWENFKELQEFKPVE

SEQ ID NO: 154 - protein, 89 aa, Artificial Sequence
  Synthetically generated peptide
GGIKDVPGNENDLHLQELARFAVDEHNKKANALLGFEKLVKAKTQVVAGTMYYLTIEVKDGEVKKLYEAKVWEKPWENFKELQEFKPVE

SEQ ID NO: 155 - protein, 89 aa, Artificial Sequence; identical to SEQ ID NO: 154
  Synthetically generated peptide

SEQ ID NO: 156 - protein, 89 aa, Artificial Sequence
  Synthetically generated peptide
GGIKDVPGNENDLHLQELARFAVDEHNKKANALLGFEKLVKAKTQVVAGTMYYLTIEVKDGEVKKLYEAKVWEKPWENFKELQEFKPVD

SEQ ID NO: 157 - protein, 89 aa, Artificial Sequence
  Synthetically generated peptide
GGIQDVPGSENDLHLQELARFAVDEHNKKANALLGFEKLVKVKTQVVAGTMYYLTIEVKDGEVKKLYEAKVWEKPWENLKGLQEFKPVE

SEQ ID NO: 158 - protein, 89 aa, Artificial Sequence
  Synthetically generated peptide
GGIQDVPGSENDLHLQELARFAVDEHNKKANALLGFEKLVKAKTQVVAGTMYYLTIEVKDGEVKKLYEAKVWEKPWENLKGLQEFKPVE

SEQ ID NO: 159 - protein, 89 aa, Artificial Sequence
  Synthetically generated peptide
GGIKDVPGNENDLHLQELARFAVDEHNKKANALLGFEKLVKAKTQVVAGTMYYLTIEVKDGEVKKLYEAKVWEKPWENLKGLQEFKPVE

SEQ ID NO: 160 - protein, 89 aa, Artificial Sequence
  Synthetically generated peptide
GGIQDVPGSENDLHLQELARFAVDEHNKKANALLGFEKLVKAKTQVVAGTMYYLTIEVKDGEVKKLYEAKVWEKPWENFKELQEFKPVE

SEQ ID NO: 161 - protein, 89 aa, Artificial Sequence
  Synthetically generated peptide
GGIQDVPENENDLHLQELARFAVDEHNKKANALLGFEKLVKAKTQVVAGTMYYLTIEVKDGEVKKLYEAKVWEKPWEKFKELQEFKPVE

SEQ ID NO: 162 - protein, 89 aa, Artificial Sequence
  Synthetically generated peptide
GGIKDVPANENDLQLQELARFAVNEHNQKANALLGFEKLVKAKTQVVAGTMYYLTIEVKDGEVNKLYEAKVWEKPWENFKQLQEFKPVE

SEQ ID NO: 163 - protein, 89 aa, Artificial Sequence
  Synthetically generated peptide
GGIKDVPANENDLQLQELARFAVNEHNQKANALLGFEKLVKAKTQVVAGTMYYLTIEVKDGEVKKLYEAKVWEKPWENFKQLQEFKPVE

SEQ ID NO: 164 - protein, 67 aa, Artificial Sequence
  Synthetically generated peptide
VSEHKNKTNALLEFEKVVRLKQQVVAGMMYYITIQVNEGGAKKMYEAKVWERPWMDFKKLMEFRPAE

SEQ ID NO: 165 - protein, 72 aa, Artificial Sequence
  Synthetically generated peptide
LARFAVSEHKNKTNALLEFEKVVRLKQQVVAGMTYYITIQVNEGGAKKMYEAKVWERPWMDFKKLMEFRPAE

SEQ ID NO: 166 - protein, 89 aa, Artificial Sequence
  Synthetically generated peptide
GGIVDSLRRENDPYIVDLARFAVSEHNKEGNTQLELEKVVKVKEQAVAGRLYYITIQVDEGGAKKLYEAKVLEQLWLDVKKLVEFKPAE

SEQ ID NO: 167 - protein, 89 aa, Artificial Sequence
  Synthetically generated peptide
GGIVDSLGRENDPYIVDLARFAVSEHNKEGNTQLELEKVVKVKEQAVAGRLYYITIQVDEGGAKKLYEAKVLEQLWLDVKKLVEFKPAE

SEQ ID NO: 168 - protein, 89 aa, Artificial Sequence
  Synthetically generated peptide
GGIVDSPGRENDPYIVDLARFAVSQHNKEANTQLELEKVVKVKEQAIAGRLYYITIQVDEGGAKKLYKAKVLEQLWLDVKKLLEFKPAE

SEQ ID NO: 169 - protein, 90 aa, Artificial Sequence
  Synthetically generated peptide
GGISDSPMGQENDLDVIALARFAVSEHNNKANALLEFENVVKVKKQTVAGTMHYITIRVTEGGAKKLYEAKVWEKPWENFKKLEEFKLVE

SEQ ID NO: 170 - protein, 90 aa, Artificial Sequence; identical to SEQ ID NO: 169
  Synthetically generated peptide

SEQ ID NO: 171 - protein, 88 aa, Artificial Sequence
  Synthetically generated peptide
GGIKDSPMGQENDLDVIARFAVSEHNNKANALLEFENVVKLKKQTVAGTMHYITIRVTEGGAKKLYEAKVWEKPWENFKQLQEFKPVE

SEQ ID NO: 172 - protein, 83 aa, Artificial Sequence
  Synthetically generated peptide
GDVRDAPVGRENDLEAIELARFAVAEHNSKTNAMLEFERLVKVRHQVVAGTLHHFTVEVKEAGGGEKKLYEAKVWEKAWENFK

SEQ ID NO: 173 - protein, 92 aa, Artificial Sequence
  Synthetically generated peptide
GDVRDAPVGRENDLEAIELARFAVAEHNSKTNAMLEFERLVKVRHQVVAGTLHHFTVEVKEAGGGEKKLYEAKVWEKAWENFKQLQSFELVG

SEQ ID NO: 174 - protein, 81 aa, Artificial Sequence
  Synthetically generated peptide
ENDLEAIELARFAVAEHNSKTNAMLEFERLVKVRHQVVAGTMHHFTVQVKEAGGGKKLYEAKVWEKVWENFKQLQSFQPVG

SEQ ID NO: 175 - protein, 90 aa, Artificial Sequence
  Synthetically generated peptide
GGVQDAPAGRENDLETIELARFAVAEHNAKANALLEFEKLVKVRQQVVAGCMHYFTIEVKEGGAKKLYEAKVWEKAWENFKQLQEFKPAA

SEQ ID NO: 176 - protein, 90 aa, Artificial Sequence
  Synthetically generated peptide
GGVQDAPAGRENDLETIELARFAVAEHNAKANALLEFERLVKVRQQVVAGCMHYFTIEVKEGGAKKLYEAKVWEKAWENFKQLQEFKPAA

SEQ ID NO: 177 - protein, 91 aa, Artificial Sequence
  Synthetically generated peptide
GGIHDAPAGRENDLTTVELARFAVAEHNSKANAMLELERVVKVRQQVVGGFMHYLTVEVKEPGGANKLYEAKVWERAWENFKQLQDFKPLD

SEQ ID NO: 178 - protein, 90 aa, Artificial Sequence
  Synthetically generated peptide
GGIYDAPLNNENGFDKEDLARFAVREYNNKNNALLEFVRVVKAKEQVVSGMMHYLTVEVNDAGKKKLYEAKVWEQVWMNFRQLQEFTYLG

SEQ ID NO: 179 - protein, 89 aa, Artificial Sequence
  Synthetically generated peptide
GTSRDVDPNANDLQVESLARFAVDEHNKKENVSLEYRRLIGAKTQVVAGTMHHLTVEVADGETKKVYEAKVLEKAWENLKKLEDFTHLR

SEQ ID NO: 180 - protein, 89 aa, Artificial Sequence
  Synthetically generated peptide
GGVRDVDPNANDLQVESLARFAVDEHNKKENVSLEYRRLIGAKTQVVAGTMHHLTVEVADGETKKVYEAKVLEKAWENLKKLEDFTHLR

SEQ ID NO: 181 - protein, 89 aa, Artificial Sequence
  Synthetically generated peptide
GGVRDIDANANDLQVESLARFAVDEHNKNENLTLEYKRLLGAKTQVVAGTMHHLTVEVADGETNKVYEAKVLEKAWENLKQLESFNHLH

SEQ ID NO: 182 - protein, 89 aa, Artificial Sequence
  Synthetically generated peptide
GGVRDIDANANDLQVESLARFAVDEHNKNENLTLEYKRLLGAKTQVVAGTMHHLTVEVADGETNKVYEAKVLEKAWENLKQLESFNHHH

SEQ ID NO: 183 - protein, 89 aa, Artificial Sequence
  Synthetically generated peptide
GGVHDSQSSQNSAEIDGLARFAVDEHNKKENAILEFARVVKAKEQVVAGTMHHLTIEAIEAGKKKLYEAKVWVKPWLNFKELHEFKDAS

SEQ ID NO: 184 - protein, 89 aa, Artificial Sequence; identical to SEQ ID NO: 183
  Synthetically generated peptide

SEQ ID NO: 185 - protein, 89 aa, Artificial Sequence
  Synthetically generated peptide
GGVHDSQSSQNSAEIDGLARFAVDEHNKKENAILEFARVVKAKEQVVAGTMHHLTIEAIEAGKKKLYEAKVWAKPWLNFKELHEFKDAS

SEQ ID NO: 186 - protein, 89 aa, Artificial Sequence
  Synthetically generated peptide
GGVHDSQSSQNSAEIDGLARFAVDEHNKKENAILEFARVVKAKEQVVAGTMHHLTIEAIEVGKKKLYEAKAWVKPWLNFKELHEFKDAS

SEQ ID NO: 187 - protein, 89 aa, Artificial Sequence
  Synthetically generated peptide
GGVHDSQSSQNSAEIDGLARFAVDEHNKKENAILEFARVVKAKEQVVAGTMHHLTIEAIEVGKKKLYEAKVWVKPWLNFKELHEFKDAS

SEQ ID NO: 188 - protein, 89 aa, Artificial Sequence
  Synthetically generated peptide
GGVQDSQSSQNSAEIDGLARFAVDEHNKKENAILEFARVVKAKEQVVAGTMHHLTIEAIEAGKKKLYEAKVRVKPWLNFKELHEFKDAS

SEQ ID NO: 189 - protein, 89 aa, Artificial Sequence
  Synthetically generated peptide
GGVHDSQSSQNSAEIDGLARFAVDEHNKKENAILEFARVVKPKDQVFAGPMHHLTIEAIEAGKKKLNEAKVWVNPWLNFKELHEFKDAG

SEQ ID NO: 190 - protein, 89 aa, Artificial Sequence
  Synthetically generated peptide
GGVHDSQSSQNSAEIDGLARFAVDEHNKKENAILEFARVVKPKEQVFAGPMHHLTIEAIEAGKKKLYEAKVWVNPWLNFKELHEFKDAG

SEQ ID NO: 191 - protein, 89 aa, Artificial Sequence
  Synthetically generated peptide
GGVHDSQSSQNSAEIDGLARFAVDEHNKKENAILEFARVVKPKEQVFAGTMHHLTIEAIEAGKKKLYEAKVWVKPWLNFKELHEFKDAG

SEQ ID NO: 192 - protein, 89 aa, Artificial Sequence
  Synthetically generated peptide
GGVQDSQSSQNSAEIDGLARFAVDEHNKKENAILEFARVVKAKEQVFAGPMHHLTIEAIEAGKKKLYEAKVWVKPWLNFKESHEFKDAG

SEQ ID NO: 193 - protein, 89 aa, Artificial Sequence
  Synthetically generated peptide
GGVHDSQSSQNSAEIDGLARFAVDEHNKKENAILEFARVVKAKEQVFAGTMHHLTIEAIEAGKKKLYEAKVWVKPWLNFKELHEFKDAG

SEQ ID NO: 194 - protein, 89 aa, Artificial Sequence; identical to SEQ ID NO: 193
  Synthetically generated peptide

SEQ ID NO: 195 - protein, 89 aa, Artificial Sequence
  Synthetically generated peptide
GGVHDSQSSQNSAEIDGLARFAVDEHNKKENAILEFARVVKAKEQVFAGTMHHLTIEAIEAGKKKLYEAKVWVKPWLNFKELHEFKDAS

SEQ ID NO: 196 - protein, 89 aa, Artificial Sequence
  Synthetically generated peptide
GGVHDSQSSQNSAEIDGLARFAVDEHNKKENAILEFARLVKAKDQVFAGTMHHLTIEAIEAGKKKLYEAKVWVNPWLNFKELHEFKDAS

SEQ ID NO: 197 - protein, 89 aa, Artificial Sequence
  Synthetically generated peptide
GGVHDSQSSQNSAEIDGLARFAVDEHNKKENAILEFARLVKAKEQVVAGTMHHLTIEAIEAGKKKLYEAKVWVKPWLNFKELHEFKDAG

SEQ ID NO: 198 - protein, 89 aa, Artificial Sequence
  Synthetically generated peptide
GGVHDSQSSQNSAEIDGLARFAVDEHNKKENAILEFARLVKAKEQVVAGTMHHLTVEAIEAGKKKLYEAKVWVKPWLNFKELHEFKDAS

SEQ ID NO: 199 - protein, 89 aa, Artificial Sequence
  Synthetically generated peptide
GGVHDSQSSQNSAEIDGLARFAVDEHNKKENAILEFARVVKAKEQVVAGPMHHLTIEAIEAGKKKLYEAKVWVKPWLNFKELHEFKDAS

SEQ ID NO: 200 - protein, 89 aa, Artificial Sequence
  Synthetically generated peptide
GGVHDSQSSQNSAEIDGLARFAVDEHNKKENAILEFARVVKAKEQVVAGPMHHLTIEAIEAGKKKLYEAKVWVKPWLNFKELHEFKDAG

SEQ ID NO: 201 - protein, 89 aa, Artificial Sequence
  Synthetically generated peptide
GGVHDSQSSQNSAEIDGLARFAVDEHNKKENAILEFARVVKAKEQVVAGTMHHLTIEAIEAGKKKLYEAKVWVKPWLNFKELHEFKDAG

SEQ ID NO: 202 - protein, 89 aa, Artificial Sequence; identical to SEQ ID NO: 201
  Synthetically generated peptide

SEQ ID NO: 203 - protein, 89 aa, Artificial Sequence; identical to SEQ ID NO: 201
  Synthetically generated peptide

SEQ ID NO: 204 - protein, 89 aa, Artificial Sequence
  Synthetically generated peptide
GGVHDSQSSQNSAEIDGLARLAVDEHNKKENAILEFARVVKAKEQVVAGTMHHLTIEAIEAGKKRLYEAKVWVKPWLNFKELHEFKDAG

SEQ ID NO: 205 - protein, 89 aa, Artificial Sequence
  Synthetically generated peptide
GGVHDSQSSQNSAEIDGLARFAIDEHNKKENAILEFARVVKAKEQVVAGTMHHLTIEAIEAGKKKLYEAKVWVKPWLNFKELHEFKDAG

SEQ ID NO: 206 - protein, 89 aa, Artificial Sequence
  Synthetically generated peptide
GGVHDSQSSQNSAEIDSLARFAVDEHNKKENAILEFARVVKAKEQVVAGTMHHLTIEAIEAGKKKLYEAKVWVKPWLNFKELHEFKDAG

SEQ ID NO: 207 - protein, 89 aa, Artificial Sequence
  Synthetically generated peptide
GGVHDSQTSQNSAEIDGLARFAVDEHNKKENAILEFARVVKAKEQVVAGTMHHLTIEAIEAGKKKLYEAKVWVKPWLNFKELHEFKDAS

SEQ ID NO: 208 - protein, 89 aa, Artificial Sequence
  Synthetically generated peptide
GGVHDSQSSQNSAEIDGLARFAVDEHNKKENAMLEFARVVKAKEQVVAGTMHHLTIEAIEAGKKKLYEAKVWVKPWLNFKELHEFKDAS

SEQ ID NO: 209 - protein, 90 aa, Artificial Sequence
  Synthetically generated peptide
GGVHDSPQGTANNAEIDGIARFAVDEHNKKENAMVEFGRVLKAKEQVVAGTLHHLTIEAIEAGKKKIYEAKVWVKPWLNFKELQEFKHAT

SEQ ID NO: 210 - protein, 89 aa, Artificial Sequence
  Synthetically generated peptide
GGVHESHGAQNSAEVEDLARFAVQEHNNKENALLEFVSVVKAKEQVVAGTLHHLTIEAIEAGKKKLYQAKVWVKPWMGFKEVQEFKHAD

SEQ ID NO: 211 - protein, 89 aa, Artificial Sequence
  Synthetically generated peptide
GGIVDVEGAQNSAEVEELARFAVDEHNKKENALLQFSRLVKAKQQVVSGIMHHLTVEVIEGGKKKVYEAKVWVQAWLNSKKLHEFSPIG

SEQ ID NO: 212 - protein, 87 aa, Artificial Sequence
  Synthetically generated peptide
GGVGDVPANQNSGEVESLARFAVDEHNKKENALLEFARVVKAKEQVVAGTLHHLTLEIAGQKKLYEAKVWVKPWLNFKELQEFKPAS

SEQ ID NO: 213 - protein, 87 aa, Artificial Sequence; identical to SEQ ID NO: 212
  Synthetically generated peptide

SEQ ID NO: 214 - protein, 87 aa, Artificial Sequence; identical to SEQ ID NO: 212
  Synthetically generated peptide

SEQ ID NO: 215 - protein, 87 aa, Artificial Sequence
  Synthetically generated peptide
GGVGDVPANQNSGEVESLARFAVDEHNKKENALLEFARVVKAKEQVVAGTLHHLTLEIAGQKKLYEAKVWVKPWLNFKELQEFTPAS

SEQ ID NO: 216 - protein, 87 aa, Artificial Sequence
  Synthetically generated peptide
GGVRDVPANQNSGEVESLARFAVDEHNKKENALLEFARVVKAKEQVVAGTLHHLTLEIAGEKKLYEAKVWVKPWLNFKELQEFKPAS

SEQ ID NO: 217 - protein, 88 aa, Artificial Sequence
  Synthetically generated peptide
GGVRDVPANQNSGEVESLARFAVDEHNKKENALLEFARVVKAKEQVVAGTMHHLTLEIIEAGKKLYEAKVWVKPWLNFKELQEFKPAS

SEQ ID NO: 218 - protein, 89 aa, Artificial Sequence
  Synthetically generated peptide
GGVRDVPSNENSVEVESLARFAVDEHNKKENALLEFARVVKAKEQVVAGTMHHLTLEIIEAGKKKLYEAKVWVKPWLNFKELQEFKPST

SEQ ID NO: 219 - protein, 89 aa, Artificial Sequence
  Synthetically generated peptide
GGVRDLPANENSVEVESLARFAVDEHNKKENALLEFARVVKAKEQVVAGTMHHLTLEIIEAGKKKLYEAKVWVKPWLNFKELQEFKPAS

SEQ ID NO: 220 - protein, 89 aa, Artificial Sequence
  Synthetically generated peptide
GGVHDLRGNQNSGEIESLARFAIQEHNKQQNKILEFKKIVKAREQVVAGTMYHLTLEAKEGDQTKNFEAKVWVKPWMNFKQLQEFKESS

SEQ ID NO: 221 - protein, 89 aa, Artificial Sequence; identical to SEQ ID NO: 220
  Synthetically generated peptide

SEQ ID NO: 222 - protein, 89 aa, Artificial Sequence; identical to SEQ ID NO: 220
  Synthetically generated peptide

SEQ ID NO: 223 - protein, 89 aa, Artificial Sequence; identical to SEQ ID NO: 220
  Synthetically generated peptide

SEQ ID NO: 224 - protein, 89 aa, Artificial Sequence
  Synthetically generated peptide
GGIQDSPSSENSLEIESLARFAVDQHNAKQNSLLEFARVVKAREQVVAGTLHHLTLEAIDAGEKKIYEAKVWVKPWMNFKELTEFKHAG

SEQ ID NO: 225 - protein, 89 aa, Artificial Sequence; identical to SEQ ID NO: 224
  Synthetically generated peptide

SEQ ID NO: 226 - protein, 87 aa, Artificial Sequence
  Synthetically generated peptide
GGLRDSQGSQNSVQTEARFAVDEHNKKQNSLLEFSRVVRTQEQVVAGTLHHLTLEAIEAGEKKLYEAKVWVKPWLNFKELQEFKPAG

SEQ ID NO: 227 - protein, 89 aa, Artificial Sequence
  Synthetically generated peptide
GGVKENPAAANSADSDGLGRFAVDEHNRRENALLEFVRVVEAKEQVVAGTLHHLTLEAVEAGRKKLYEAKVWVKPWLDFKELQEFSHKG

SEQ ID NO: 228 - protein, 89 aa, Artificial Sequence
  Synthetically generated peptide
GGVKENPAAANSAESDGLGRFAVDEHNRRENALLEFVRVVEAKEQVVAGTLHHLTLEAVEAGRKKLYEAKVWVKPWLDFKELQEFSHKG

SEQ ID NO: 229 - protein, 89 aa, Artificial Sequence
  Synthetically generated peptide
GGKSENPAAANSLETDGLARFAVDEHNKRENALLEFVRVVEAKEQTVAGTVHHLTLEALEAGRKKLYEAKVWVKPWLDFKELQEFRHTG

SEQ ID NO: 230 - protein, 87 aa, Artificial Sequence
  Synthetically generated peptide
GGAHDAPSAANSVETDARFAVDEHNKRENALLEFVRVVEAKEQVVAGTLHHLTLEALEAGRKKVYEAKVWVKPWLDFKELQEFRNTG

SEQ ID NO: 231 - protein, 90 aa, Artificial Sequence
  Synthetically generated peptide
GGVHDSHGSSQNSDEIHSLAKLAVDEHNKKENAMIELARVVKAQEQTVAGKLHHLTLEVMDAGKKKLYEAKVWVKPWLNFKELQEFKHVE

SEQ ID NO: 232 - protein, 90 aa, Artificial Sequence
  Synthetically generated peptide
GGVHDSHGSSQNSDEIHSLAKFAVDEHNKKENAMIELARVVKAQEQTVAGKLHHLTLEVMDAGKKKLYEAKVWVKPWLNFKELQEFKHVE

SEQ ID NO: 233 - protein, 90 aa, Artificial Sequence
  Synthetically generated peptide
GGIRDSHPESQNSDEIHSLAKFAVDEHNKKENAMFELARVVKAKEQVVAGTLHHLTLEVVDAGKKKLYEAKVWVKPWLNFKELQEFTHVE

SEQ ID NO: 234 - protein, 89 aa, Artificial Sequence
  Synthetically generated peptide
GGISDSASAENSVEIESLARFAVEEHNKKENAMIELVRVVKAEEQVVAGKLHHLTLEVIDAGKRKLYEAKVWLKPWMNFKELQGFNHIE

SEQ ID NO: 235 - protein, 89 aa, Artificial Sequence; identical to SEQ ID NO: 234
  Synthetically generated peptide

SEQ ID NO: 236 - protein, 90 aa, Artificial Sequence
  Synthetically generated peptide
GGFSDSKNDWNGGKEIDDIALFAVQEHNRRENAVLELARVLKATEQVVAGKLYRLTLEVIEAGEKKIYEAKVWVKPWMNFKQLQEFKNII

SEQ ID NO: 237 - protein, 90 aa, Artificial Sequence; identical to SEQ ID NO: 236
  Synthetically generated peptide

SEQ ID NO: 238 - protein, 86 aa, Artificial Sequence
  Synthetically generated peptide
GGVHDSNSNPDTHSLARFAVDQHNTKENGLLELVRVVEAREQVVAGTLHHLVLEVLDAGKKKLYEAKIWVKPWMDFKQLQEFKHVR

SEQ ID NO: 239 - protein, 64 aa, Artificial Sequence
  Synthetically generated peptide
AHYNKNQGAALEFTRVLKSKRQVVTGTLHDLIAADAGKKSVYRAKVWVKPWEDFKSVVEFRLVG

SEQ ID NO: 240 - protein, 84 aa, Artificial Sequence
  Synthetically generated peptide
GVLAALRERAEAEDAARFAVAHYNKNQGAALEFTRVLKSKRQVVTGTLHDLIAADAGKKSVYRAKVWVKPWEDFKSVVEFRLVG

SEQ ID NO: 241 - protein, 85 aa, Artificial Sequence
  Synthetically generated peptide
GMLAAIRREQAEAEDAARFAVAEYNKNQGAELEFARIVKAKRQVVTGTLHDLMLEVVDSGKKSKAKVWVKPWLDFKAVVEFRHVG

SEQ ID NO: 242 - protein, 90 aa, Artificial Sequence
  Synthetically generated peptide
GAPRDVPAGGENSADVEELARFAVAEHNKKENALLEFGRVVKAKEQVVAGTLHHLTVEAIDAGNKKLYEAKVWVKPWLNFKELQEFRHAG

SEQ ID NO: 243 - protein, 90 aa, Artificial Sequence
  Synthetically generated peptide
GGIRDSPAGSENSLETEALGRFAVDDHNQKQNGMLEFVRVVKAKEQVVAGTLHHLVVEAIDGGKKKLYEAKVWVKPWLNFKQVQEFKHAG

SEQ ID NO: 244 - protein, 89 aa, Artificial Sequence
  Synthetically generated peptide
GAVRDNQGVANSVETESLARYAVDEHNKKENDLLEFVRVLDDKVQVVSGTMHYLKIEATEGGKKKVYEAKVWVKPWENFKQVQEFKPVS

SEQ ID NO: 245 - protein, 59 aa, Artificial Sequence
  Synthetically generated peptide
GGITEVKDFANSLVIDDLARFAVDEYSKKQNTLLEFERVLDAKQQIVAGTMYYFIATVG

SEQ ID NO: 246 - protein, 89 aa, Artificial Sequence
  Synthetically generated peptide
GGFTEVKDFANSIVIDDLARFAVDEYNKKQNTLLEFRKVLNAKEQIVSGTLYYITLDAANGGIIKTYEAKVWVKKWENLKELQEFKPVD

SEQ ID NO: 247 - protein, 89 aa, Artificial Sequence
  Synthetically generated peptide
GGITEVKDFANSLEIEDLARFAVDEHNKKQNTLLEFGKVLNAKEQIVAGKLCYITLEATDGGVKKTYEAKVWVKPWENFKELQEFKPVD

SEQ ID NO: 248 - protein, 88 aa, Artificial Sequence
  Synthetically generated peptide
GGITEVKDNDNSVDFDELAKFAIAEHNKKENAALEFGKVIEKKQQAVQGTMYYIKVEANDGGEKKTYEAKVWVKLWENFKELQELKLV

SEQ ID NO: 249 - protein, 78 aa, Artificial Sequence
  Synthetically generated peptide
SLEIDELARFAVDEHNKKQNALLEFGKVVNTKEQVVAGKMYYITLEATNGGVKKTYEAKVWVKPWENFKELQEFKPVD

SEQ ID NO: 250 - protein, 89 aa, Artificial Sequence
  Synthetically generated peptide
GGIKQVEGSANSLEVESLAKFAVEDHNKKQNAMLEFSKVVNTKEQVVAGTMYYITLEATDGGKKKVYEAKVWVKPWMNFKQVQEFKLLG

SEQ ID NO: 251 - protein, 89 aa, Artificial Sequence
  Synthetically generated peptide
GGIREAGGSENSLEINDLARFAVDEHNKKQNALLEFGKVVNVKEQVVAGTMYYITLEATEGGKKKAYEAKVWVKPWQNFKQVEDFKLIG

SEQ ID NO: 252 - protein, 89 aa, Artificial Sequence
  Synthetically generated peptide
GGIHEKEGSANSVEMDELARFAVDQHNKKQNALLEFVKVVNVKEQVVSGTLYYITLEATGGGQKKLYEAKVWVKPWMNFKELQDFQLAS

SEQ ID NO: 253 - protein, 84 aa, Artificial Sequence
  Synthetically generated peptide
GGSSAISLEIDELAKFAVDHYNSIENALLEFPRVVNTKEQVVAGTIYYITLEATDGGVKKLYEANVWVKPGVNFKEVQVFKYVG

SEQ ID NO: 254 - protein, 90 aa, Artificial Sequence
  Synthetically generated peptide
GGIKDSGGSSANSLEIDELAKFAVDHYNSKENALLEFQRVVNTKEQVVAGTIYYITLEATDGGVKKLYEAKVWVKPWVNFKEVQDFKYVG

SEQ ID NO: 255 - protein, 71 aa, Artificial Sequence
  Synthetically generated peptide
GGVSDVKGHENSLQIDDLARFAVDDHNKKANTLLQFKKVVNAKQQVVSGTIYILTLEVEDGGKKKVYEAKI

SEQ ID NO: 256 - protein, 71 aa, Artificial Sequence; identical to SEQ ID NO: 255
  Synthetically generated peptide

SEQ ID NO: 257 - protein, 89 aa, Artificial Sequence
  Synthetically generated peptide
GGVSDVKGHENSLQIDDLARFAVDDHNKKANTLLQFKKVVNAKQQVVSGTIYILTLEVEDGGKKKVYEAKIWEKPWLNFKEVQEFKLIG

SEQ ID NO: 258 - protein, 89 aa, Artificial Sequence
  Synthetically generated peptide
GGLQDVEGDANNLEYQELARFAVDEHNKKTNAMLQFKRVVNVKQAVVEGLKYCITLEAVDGHKTKVYEAEIWLKLWENFRSLEGFKLLG

SEQ ID NO: 259 - protein, 79 aa, Artificial Sequence
  Synthetically generated peptide
ESVEIDSLARFAVEEHNKKQNALLEFGRVVSAQQQVVSGTLYTITLEAKDGGQKKVYEAKVWEKPWLNFKELQEFKLVG

SEQ ID NO: 260 - protein, 89 aa, Artificial Sequence
  Synthetically generated peptide
GGNRDVAGNQNSLEIDSLARFAVEEHNKKQNALLEFGRVVSAQQQVVSGTLYTITLEAKDGGQKKVYEAKVWEKPWLNFKELQEFKHVG

SEQ ID NO: 261 - protein, 77 aa, Artificial Sequence
  Synthetically generated peptide
NSVEIDARFAVEEHNKKQNALLEFEKVVTAKQQVVSGTLYTITLEAKDGGQKKVYEAKVWEKSWLNFKEVQEFKLVG

SEQ ID NO: 262 - protein, 89 aa, Artificial Sequence
  Synthetically generated peptide
GGIKEVEESANSVEIDNLARFAVDDYNKKQNALLEFKRVVSTKQQVVAGTMYYITLEVADGGQTKVYEAKVWEKPWLNFKEVQEFKPIG

SEQ ID NO: 263 - protein, 89 aa, Artificial Sequence
  Synthetically generated peptide
GGVRDVPGNQNSLAIDGLARFAVEEHNKKQNALLEFSRVISAKEQVVAGTIHHITLEVKDGVNKKVYEAKVWEKSWMNFKEVQEFKLVE

SEQ ID NO: 264 - protein, 89 aa, Artificial Sequence
  Synthetically generated peptide
GAPREVAGNENSLEIDSLARFAVDEHNKKQNGLLEFKRVISAKQQVVAGTLHHITLEAASGDSKNVYEAKVWEKPWMNFKEVQEFKLAG

SEQ ID NO: 265 - protein, 89 aa, Artificial Sequence
  Synthetically generated peptide
GGITDVPGAANSVEIANLARFAVDDHNKKQNGVLEFVRVISAKQQVVSGILYYITLEAKDGETKKVYKTKVWVREWLNPKEVQEFNLVT

SEQ ID NO: 266 - protein, 89 aa, Artificial Sequence; identical to SEQ ID NO: 265
  Synthetically generated peptide

SEQ ID NO: 267 - protein, 89 aa, Artificial Sequence
  Synthetically generated peptide
GGIIDVSGSANCLEIAILARFAVDDHNKKQNGVLEFVRVISAKQQVVSGILYYITLEAKDGETKKVYKTKVWVREWLNPKEVQEFNLVT

SEQ ID NO: 268 - protein, 89 aa, Artificial Sequence
  Synthetically generated peptide
GGITDVHGAANSVEINNLARFAVEEQNKRENSVLEFVRVISAKQQVVAGVNYYITLEAKDGLIKNEYEAKVWVREWLNSKELLEFKPVN

SEQ ID NO: 269 - protein, 87 aa, Artificial Sequence
  Synthetically generated peptide
GGVGDVPSDTLHIENLARFAVDQYNKNENANLEFVRVIDAKEQVVEGFIYYITLEAKDGESKNVYEAKVWERSWLNSIELLEFKPVD

SEQ ID NO: 270 - protein, 87 aa, Artificial Sequence; identical to SEQ ID NO: 269
  Synthetically generated peptide

SEQ ID NO: 271 - protein, 89 aa, Artificial Sequence
  Synthetically generated peptide
GGFTDITGAQNSIDIENLARFAVDEHNKKENAVLEFVRVISAKKQVVSGTLYYITLEANDGVTKKVYETKVLEKPWLNIKEVQEFKPIT

SEQ ID NO: 272 - protein, 48 aa, Artificial Sequence
  Synthetically generated peptide
GFTDITGAQNSIDIENLARFAVDEHNKKENAVLEFVRVKSAKKQVVSG

SEQ ID NO: 273 - protein, 86 aa, Artificial Sequence
  Synthetically generated peptide
GGVTECKNFENNVEIETIAKFAVEEHNKKENATLEFVKVVSAKEQVVSGKIYYITIETNDGKTYEAKLWVKPWENFQELQEFKPAA

SEQ ID NO: 274 - protein, 88 aa, Artificial Sequence
  Synthetically generated peptide
GGVRDVPDHNSAETEELARFAVQEHNKKANTRLEFSRVVKAKEQVVAGTMYYITLEVVEAGQKKIYEAKVWVKLWENFKELQEFKPVG

SEQ ID NO: 275 - protein, 57 aa, Artificial Sequence
  Synthetically generated peptide
HLEYVENLNVKEQLVAGTLYYITLVATDAGKKKIYETKIWVKEWEDFKKVVEFKLVG

SEQ ID NO: 276 - protein, 88 aa, Artificial Sequence
  Synthetically generated peptide
GDIVDVPDPNIPPLQDLARFAVQDYNKAQNAHLEYVENLNVKEQLVAGTLYYITLVATDAGKKKIYETKIWVKEWEDFKKVVEFKLVG

SEQ ID NO: 277 - protein, 88 aa, Artificial Sequence
  Synthetically generated peptide
GGFTDVPFPNNPEFQDLARFAVQDYNKKENAHLEYVENLNVKEQLVAGMIYYITLVATDAGKKKIYEAKIWVKEWEDFKKVVEFKLVG

SEQ ID NO: 278 - protein, 88 aa, Artificial Sequence
  Synthetically generated peptide
GGITDVPFPNNPEFQDLARFAIQVYNKKENVHLEFVENLNVKQQVVAGMMYYITLAAIDAGKKKIYETKIWVKEWEDFKKVVEFKLVG

SEQ ID NO: 279 - protein, 89 aa, Artificial Sequence
  Synthetically generated peptide
GGIVNVPNPNNTKFQELARFAIQDYNKKQNAHLEFVENLNVKEQVVAGIMYYITLAATDDAGKKKIYKAKIWVKEWEDFKKVVEFKLVG

SEQ ID NO: 280 - protein, 58 aa, Artificial Sequence
  Synthetically generated peptide
GGIISVPFPNSPEFQDLARFAVQDYNNTQNAHLEFVENLSVKEQLVSGMMYYITLAAT

SEQ ID NO: 281 - protein, 88 aa, Artificial Sequence
  Synthetically generated peptide
GGIINVPNPNSPEFQDLARFAVQDYNNTQNAHLEFVENLNVKEQLVSGMMYYITLAATDAGNKKEYEAKIWVKEWEDFKKVIDFKLVG

SEQ ID NO: 282 - protein, 88 aa, Artificial Sequence
  Synthetically generated peptide
GGIINVPFPNNPEFQDLARFAVQDYNKKENAHLEFVENLNVKEQLVAGMLYYITLVAIDAGKKKIYEAKIWVKEWENFKKVIEFKLIG

SEQ ID NO: 283 - protein, 88 aa, Artificial Sequence
  Synthetically generated peptide
GGITNVPFPNLPEFKDLARFAVQDYNKKENAHLEFVENLNVKEQVVAGIIYYITLVATDAGKKKIYETKILVKGWENFKEVQDFKLVG

SEQ ID NO: 284 - protein, 88 aa, Artificial Sequence
  Synthetically generated peptide
GGITNVPFPNLPQFKDLARFAVQDYNKKENAHLEFVENLNVKEQVVAGIIYYITLVATDAGKKKIYETKILVKGWENFKEVQEFKLVG

SEQ ID NO: 285 - protein, 88 aa, Artificial Sequence
  Synthetically generated peptide
GGIIIVPFPNSPEFQDLARFAVQDFNKKENGHLEFVENLNVKEQVVAGMMYYITLAATDARKKEIYETKILVKEWENFKEVQEFKLVG

SEQ ID NO: 286 - protein, 58 aa, Artificial Sequence
  Synthetically generated peptide
GGLTDVPFPNNPEFQDLARFAVQDYNKKENGHLEFVEVLNVKEQVVAGMMYYITLAAT

SEQ ID NO: 287 - protein, 88 aa, Artificial Sequence
  Synthetically generated peptide
GGFTEVPFPNSPEFQDLTRFAVHQYNKDQNAHLEFVENLNVKKQVVAGMLYYITFAATDGGKKKIYETKIWVKVWENFKKVVEFKLVG

SEQ ID NO: 288 - protein, 57 aa, Artificial Sequence
  Synthetically generated peptide
HLEFVEVLNVKEQVVAGMMYYITLAVTDAGKKKIYEANIWVKEWEHFIKVVEFKPVS

SEQ ID NO: 289 - protein, 59 aa, Artificial Sequence
  Synthetically generated peptide
NAHLEFVEVLNVKEQVVAGMMYYITLVATDDGYKKIYKTKIWVKEWENFKEVQEFKQIV

SEQ ID NO: 290 - protein, 88 aa, Artificial Sequence
  Synthetically generated peptide
GGLVDVPFENKVEFDDLARFAVQDYNQKNDSSLEFKKVLNVKQQIVAGIMYYITFEATEGGNKKEYEAKILLRKWEDLKKVVGFKLVG

SEQ ID NO: 291 - protein, 35 aa, Artificial Sequence
  Synthetically generated peptide
RKSLEHFNEIHSTKYEFVRFIKANHQVSAGMMYFI

SEQ ID NO: 292 - protein, 61 aa, Artificial Sequence
  Synthetically generated peptide
GGWNPIPDVSDSHIQELGGWALGQAKHQKLAADGLRFRRVVRGEQQVVSGMNYRLYVDAAD

SEQ ID NO: 293 - protein, 61 aa, Artificial Sequence; identical to SEQ ID NO: 292
  Synthetically generated peptide

SEQ ID NO: 294 - protein, 64 aa, Artificial Sequence
  Synthetically generated peptide
GGWSPIRNVSDPHIQELGGWAVTEHVRRANDGLRFGEVTGGEEQVVSGMNYKLVLDATDADGKV

SEQ ID NO: 295 - protein, 59 aa, Artificial Sequence
  Synthetically generated peptide
GGWKPIKNVNDPHVREIGRWAVSEHIKTANDGLGFGRVVSGEEQIVAGKNYRLRIQATK

SEQ ID NO: 296 - protein, 59 aa, Artificial Sequence
  Synthetically generated peptide
GGWKPIKNVNDPHVQEIGRWAVSEHIKTANDGLGFGRVVSGEEQIVAGKNYRLRIQATK

SEQ ID NO: 297 - protein, 58 aa, Artificial Sequence
  Synthetically generated peptide
GWEPIGNINDQHIQELGRWAVLEFGKHVNCVLKFNKVVSGRQQLVSGMNYELIIEASD

SEQ ID NO: 298 - protein, 64 aa, Artificial Sequence
  Synthetically generated peptide
GGWSPISDAKDPHVVEIGVFAVSEYDKQSKSGLKFVTVVSGESQVAAGTNYRLIVTVDGSIGVA

SEQ ID NO: 299 - protein, 92 aa, Artificial Sequence
  Synthetically generated peptide
GRWSPISNVKDPHVVEVGKFAVSEYDMESKSELKFVVVVSGESKVVAGTNYRLIVAVNDGVAGPGASKNYEAIVWEKQWLKSMNLTSFKPVV

SEQ ID NO: 300 - protein, 94 aa, Artificial Sequence
  Synthetically generated peptide
GGWRPLSDVNDPHVVEIGKFSVSEYNKQSKAGLKFVAVVSGESQVVAGMNYRLIVAVNDGVETAGAGASKNYEAIVWERAWLKSMNLTSFKPAI

SEQ ID NO: 301 - protein, 89 aa, Artificial Sequence
  Synthetically generated peptide
GGWSPISNVTDPQVVEIGEFAVSEYNKRSESGLKFETVVSGETQVVSGTNYRLKVAANDGDGVSKNYLAIVWDKPWMKFRNLTSFEPAN

SEQ ID NO: 302 - protein, 89 aa, Artificial Sequence; identical to SEQ ID NO: 301
  Synthetically generated peptide

SEQ ID NO: 303 - protein, 89 aa, Artificial Sequence
  Synthetically generated peptide
GGWSPISNVTDPQVVEIGEFAVSEYNKRSESGLKFETVVSGETQVVSGTNYRLKVAANDGDGVSKNYLAIVWVKPWMKFRNLTSFEPAN

SEQ ID NO: 304 - protein, 88 aa, Artificial Sequence
  Synthetically generated peptide
GGWKPIEDPKEKHVMEIGQFAVTEYNKQSKSALKFESVEKGETQVVSGTNYRLILVVKDGPSTKKFEAVVWEKPWEHFKSLTSFKPMV

SEQ ID NO: 305 - protein, 86 aa, Artificial Sequence
  Synthetically generated peptide
GSRKPIKNVSDPDVVAVAKYAIEEHNKESKENLVFVKVVEGTTQVVSGTKYDLKIAAKDGGGKIKNYEAVVVEKLWLHSKSLESFK

SEQ ID NO: 306 - protein, 86 aa, Artificial Sequence
  Synthetically generated peptide
GSRKPIKNVSDPDVVAVAKYAIEEHNKESKEKLVFVKVVEGTTQVVSGTKYDLKIAAKDGGGKIKNYEAVVVEKLWLHSKSLESFK

SEQ ID NO: 307 - protein, 56 aa, Artificial Sequence
  Synthetically generated peptide
GQYVKIENVKDPYVQGVGEWAVKEHNRQTGESLQFAEVVSGMEQVVAGTNYKLNLA

SEQ ID NO: 308 - protein, 60 aa, Artificial Sequence
  Synthetically generated peptide
GGWRPIESLNSAEVQDVAQFAVSEHNKQANDELQYQSVVRGYTQVVAGTNYRLVIAAKDG

SEQ ID NO: 309 - protein, 60 aa, Artificial Sequence
  Synthetically generated peptide
GGWRPIENLNSAEVQDVAQFAVSEHNKQANDELQYQSVVRGYTQVVSGTNYRLVIAAKDG

SEQ ID NO: 310 - protein, 60 aa, Artificial Sequence
  Synthetically generated peptide
GGWRPIKDLNSAEVQDVAQFAVSEHNKQANDKLQYQRVVRGYSQVVAGTNYRLVIAAKDG

SEQ ID NO: 311 - protein, 43 aa, Artificial Sequence
  Synthetically generated peptide
PGWQSVPAHDPQVQDAANHAIKTIQQRSNSLVPYELHEVTDAK

SEQ ID NO: 312 - protein, 43 aa, Artificial Sequence; identical to SEQ ID NO: 311
  Synthetically generated peptide

SEQ ID NO: 313 - protein, 43 aa, Artificial Sequence
  Synthetically generated peptide
PGWQSVPPHDPQVQDAANHAVKSLQQRSNSLLPYELQEVVHAQ

SEQ ID NO: 314 - protein, 46 aa, Artificial Sequence
  Synthetically generated peptide
PGWQDVHPQDPQVQDAANHAVKSLQQKSNSLFPYELQEVVHAKSEV

SEQ ID NO: 315 - protein, 47 aa, Artificial Sequence
  Synthetically generated peptide
PGWRDVPVHDPVVKDAASHAVKSIQQRSNSLLPYELVEIVRAKAEVV

SEQ ID NO: 316 - protein, 47 aa, Artificial Sequence
  Synthetically generated peptide
PGWRDVPVHDPVVKDAADHAVKSIQQRSNSLFPYELLEIVRAKAEVV

SEQ ID NO: 317 - protein, 47 aa, Artificial Sequence
  Synthetically generated peptide
PGWREVPVEDPVVKDAAHHAVKSIQERSNSLFPYELLEILRAHAQVV

SEQ ID NO: 318 - protein, 47 aa, Artificial Sequence; identical to SEQ ID NO: 317
  Synthetically generated peptide

SEQ ID NO: 319 - protein, 89 aa, Artificial Sequence
  Synthetically generated peptide
SGWREVPGDDPEVKHVAEQAVKTIQQRSNSLFPYELLEVVHAKAEVTGEAAKYNMLLKLKRGEKEEKFKVEVHKNHEGALHVNHAEQHH

SEQ ID NO: 320 - protein, 71 aa, Artificial Sequence
  Synthetically generated peptide
SGWREVPGDDPEVKHVAEQAVKTIQQRSNSLFPYELLEVVHAKAEVTGEAAKYNMLLKLKRGEKEEKFKVE

SEQ ID NO: 321 - protein, 71 aa, Artificial Sequence; identical to SEQ ID NO: 320
  Synthetically generated peptide

SEQ ID NO: 322 - protein, 71 aa, Artificial Sequence
  Synthetically generated peptide
SGWREVPGDDPEVKHAAEQAVKTIQQRSNSLFPYELLEVVHAKAEVTGEAAKYNMLLKLKRGEKEEKFKVE

SEQ ID NO: 323 - protein, 89 aa, Artificial Sequence
  Synthetically generated peptide
SGWREVPGDDPEVQHVADHAVKSIQQRSNSLFPYELQEVVHANAEVTGEAAKYNMVLKLKRGEKEEKFKVEVHKNHEGVLHLNHMEQQH

SEQ ID NO: 324 - protein, 89 aa, Artificial Sequence
  Synthetically generated peptide
SGWREVPGDDPEVQHVADHAVKTIQQRSNSLFPYELQEVVHANAEVTGEAAKYNMVLKLKRGEKEEKFKVEVHKNHEGVLHLNHMEQQH

SEQ ID NO: 325 - protein, 89 aa, Artificial Sequence
  Synthetically generated peptide
SGWREVPGDDPEVQHVADHAVKTIQQRSNSLFPYELQEVVHANAEVTGEAAKYNMVLKLKRGEKEEKFKVEVHKNHEGVLHLNHMEQHH

SEQ ID NO: 326 - protein, 89 aa, Artificial Sequence
  Synthetically generated peptide
SGWREVPGDDPEVQHVAEHAVKTIQQRSNSLFPYELQEVVHANAEVTGETAKFNMLLKLKRGEKEEKFKVEVHKNHEGALHLNHMEQHH

SEQ ID NO: 327 - protein, 47 aa, Artificial Sequence
  Synthetically generated peptide
SGWRPVPVHDPVVQDAAHHAIKTIQERSNSLFPYELSEVVHANAEVV

SEQ ID NO: 328 - protein, 47 aa, Artificial Sequence
  Synthetically generated peptide
AEWKEVAAHDPVVQDAATHAVNTIQQRSNSLFPYQLQEIVHAKAQVV

SEQ ID NO: 329 - protein, 63 aa, Artificial Sequence
  Synthetically generated peptide
FDWRSVSTNNPEVQEAAKHAMKSLQQKSNSLFPYKLIDIILARAKVVEERVKFELLLKLERGN

SEQ ID NO: 330 - protein, 63 aa, Artificial Sequence; identical to SEQ ID NO: 329
  Synthetically generated peptide

SEQ ID NO: 331 - protein, 78 aa, Artificial Sequence
  Synthetically generated peptide
LYVQVIQAINNSVVNPSARICCPVVEITLGNYKSSTKNLPMGPNMDWNQVFAFDKSKGDVLSVTLKDGPTNTVINKRN

SEQ ID NO: 332 - protein, 66 aa, Artificial Sequence
  Synthetically generated peptide
LYVDVIRAIKNSDVDPGPCDPVVEITLGNYKSSTKDLPVGPNMDWNQVFAFDKTKGDVLSVTLKDR

SEQ ID NO: 333 - protein, 71 aa, Artificial Sequence
  Synthetically generated peptide
LYVRVVRARGVAAVGETVAEVKLGNYRGVTPATAAHHWDQVFAFSKETIQSSFVEVFVRARGSDDHVGRVW

SEQ ID NO: 334 - protein, 75 aa, Artificial Sequence
  Synthetically generated peptide
LYVNIVKAKDLSVLGEVVSEVKLGNYRGVTKKVSSNSSNPEWNQVFVFSKERIQSSVVELFVKEGNKDEYTGRVL

SEQ ID NO: 335 - protein, 78 aa, Artificial Sequence
  Synthetically generated peptide
LYVRVVKARGLKWSGEFDPFAELRLGGYSCITRHVEKTASPEWDDVFAFSRERIHAPFLDVLVRGRGFAKDDYVGSTR

SEQ ID NO: 336 - protein, 87 aa, Artificial Sequence
  Synthetically generated peptide
LYVRVVRRLTAAASTVAGGGGCNPYVEVRLGNYRGTTRHHERKAAPEWNQVFAFSRERVQASVLEVFVRDKDAVAAVARDGYVGRVA

SEQ ID NO: 337 - protein, 81 aa, Artificial Sequence
  Synthetically generated peptide
LYVRVVKARELPIMDITGSVDPFVEVRVGNYKGITRHFEKRQHPEWNQVFAFAKERMQASVLEVVVKDKDLLKDDYVGFVR

SEQ ID NO: 338 - protein, 81 aa, Artificial Sequence; identical to SEQ ID NO: 337
  Synthetically generated peptide

SEQ ID NO: 339 - protein, 81 aa, Artificial Sequence
  Synthetically generated peptide
LFVRVVKARDLPDMDVTGSLDPYVEVRVGNYRGITRHFEKQKNPEWNAVFAFSRDRMQATILEVVVKDKDLLKDDFVGLVR

SEQ ID NO: 340 - protein, 81 aa, Artificial Sequence
  Synthetically generated peptide
LFVRVVKARDLPDMDVTGSLDPYVEVRYGNYRGITRHFEKQKNPEWNAVFAFSRDRMQATILEVVVKDKDLLKDDFVGLVR

SEQ ID NO: 341 - protein, 81 aa, Artificial Sequence
  Synthetically generated peptide
LFVRVVKARDLPHMDITGSLDPYVEVHLGNYKMKTRHFEKNQRPEWDEVFAFPREVMQSTSLEVIVKDKDFIRDDYVGRVS

SEQ ID NO: 342 - protein, 81 aa, Artificial Sequence
  Synthetically generated peptide
LYVRVVKARDLPNKDLTGSLDPYVVVKIGNFKGVTTHFNKNTDPEWNQVFAFAKDNLQSNFLEVMVKDKDILLDDFVGIVK

SEQ ID NO: 343 - protein, 81 aa, Artificial Sequence; identical to SEQ ID NO: 342
  Synthetically generated peptide

SEQ ID NO: 344 - protein, 81 aa, Artificial Sequence
  Synthetically generated peptide
LFIRVVKARDLPRMDLTGSLDPYVIVKVGNFKGTTNHFEKNNSPEWNLVFAFAKENQQATTLEVVIKDKDTIHDDFVGTVR

SEQ ID NO: 345 - protein, 82 aa, Artificial Sequence
  Synthetically generated peptide
LYVSVVKARDLPVMDVSGSLDPYVEVKLGNYKGLTKHLEKNSNPIWKQIFAFSKERLQSNLLEVTVKDKDLLTKDDFVGRVH

SEQ ID NO: 346 - protein, 82 aa, Artificial Sequence; identical to SEQ ID NO: 345
  Synthetically generated peptide

SEQ ID NO: 347 - protein, 81 aa, Artificial Sequence
  Synthetically generated peptide
LYVSVVKARDLPNMDITGALDPYVEVRLGNFKGVTRHLEKNPNPVWRQVFAFSRDHLQSSQLEVVVKDKDVLKDDFVGRVV

SEQ ID NO: 348 - protein, 81 aa, Artificial Sequence
  Synthetically generated peptide
LFIKIVKARNLPSMDLTGSLDPYIEVKLGNYTGKTKHFEKNQNPVWNEVFAFSKSNQQSNVLEVIVMDKDMVKDDFVGLIR

SEQ ID NO: 349 - protein, 82 aa, Artificial Sequence
  Synthetically generated peptide
LYVRVVKAKDLPPGTITSSCDPYVEVKLGNYRGRTKHLEKKLNPEWNQVFAFSKDRIQSSVLEVFVKDKEMVGRDDYLGRVI

SEQ ID NO: 350 - protein, 80 aa, Artificial Sequence
  Synthetically generated peptide
LYVRVVKAKNLTLNSLTSTCDPYVEVRLGNYKGRTKHLDKRSNPEWNQVYAFSKDQIQSSIVIVKDKETVGRDDYIGRVA

SEQ ID NO: 351 - protein, 82 aa, Artificial Sequence
  Synthetically generated peptide
LYVRVVKAKDLPPNPVTSNCDPYVEVKIGNYKGKTKHFEKRTNPEWNQVFAFSKDKVQSSTVEVFVRDKEMVTRDEYIGKVV

SEQ ID NO: 352 - protein, 83 aa, Artificial Sequence
  Synthetically generated peptide
LYVRVVKAKELPPGSITGGCDPYVEVKLGNYKGRTKIFDRKTTIPEWNQVFAFTKERIQSSVLEVFVKDKETLGRDDILGKVV

SEQ ID NO: 353 - protein, 81 aa, Artificial Sequence
  Synthetically generated peptide
LYVRVVKAKELPGKDMTGSCDPYVEVKLGNYKGTTRHFEKKSNPEWNQVFAFSKDRIQASFLEATVKDKDFVKDDLIGRVV

SEQ ID NO: 354 - protein, 81 aa, Artificial Sequence; identical to SEQ ID NO: 353
  Synthetically generated peptide

SEQ ID NO: 355 - protein, 81 aa, Artificial Sequence
  Synthetically generated peptide
LYVRVVKAKELPGKDLTGSCDPYVEVKLGNYRGTTRHFEKKSNPEWNQVFAFSKDRVQASYLEATVKDKDLVKDDLIGRVV

SEQ ID NO: 356 - protein, 81 aa, Artificial Sequence
  Synthetically generated peptide
LYVRVVKAKELPGKDVTGSCDPYVEVKLGNYRGMTKHFEKRSNPEWKQVFAFSKERIQASILEVVVKDKDVVLDDLIGRIM

SEQ ID NO: 357 - protein, 81 aa, Artificial Sequence
  Synthetically generated peptide
LYVRVVKAKDLPSKDITGSCDPYVEVKLGNYKGTTRHFEKKTNPEWNQVFAFSKERIQSSVVEIIVKDKDFVKDDFIGRVL

SEQ ID NO: 358 - protein, 82 aa, Artificial Sequence
  Synthetically generated peptide
LYVHVVKAKDLPAVSAAGTIDPFVEVKLGNFKGTTPVLGGNHNPSWKQVFAFSATHLQAHVLEVAVKAKDLAGGDDLIGRVG

SEQ ID NO: 359 - protein, 73 aa, Artificial Sequence
  Synthetically generated peptide
LYIRIVKARALPSNDLFVEVTIGRYKGRTKRSTNPYPNLEFDEVFAFNSDRLQGNMLEVMKKMNEEEIIGQCR

SEQ ID NO: 360 - protein, 73 aa, Artificial Sequence; identical to SEQ ID NO: 359
  Synthetically generated peptide

SEQ ID NO: 361 - protein, 77 aa, Artificial Sequence
  Synthetically generated peptide
LYARIVRARALPVNDSFVAVKIGSYKGRTKQILNSNPNPEFHETFAFTKTRLQGDILEVVVRNRDNPNEDDIVGKCK

SEQ ID NO: 362 - protein, 84 aa, Artificial Sequence
  Synthetically generated peptide
LFVRVIKARKLPDMDANGSLDPYVEVKFGAYNRGVTRCFKRNKNPEWNETFAFSFQHDKIPSPTVDIVVNDKDLVRDDFVGKLH

SEQ ID NO: 363 - protein, 81 aa, Artificial Sequence
  Synthetically generated peptide
LFVRIVKRLPPNESAYVKVRTSNHFVRSKPAVNRPGESVDSPEWNQVFALGHNRSDSAVTGATLEISAWDASSESFLGGVC

SEQ ID NO: 364 - protein, 81 aa, Artificial Sequence; identical to SEQ ID NO: 363
  Synthetically generated peptide

SEQ ID NO: 365 - protein, 80 aa, Artificial Sequence
  Synthetically generated peptide
LFVRVVKVRGIRACEGPYVKIQAGPHTLRSRPGRDVSGTGNPEWNQVFAINHAKPEPTLEISVWDGGAPSPIEAFLGGVC

SEQ ID NO: 366 - protein, 85 aa, Artificial Sequence
  Synthetically generated peptide
LFVRVVRRLPAGAHPHVRVAAGGRHASTREARRGAFFEWDQTFAFVRDPGATDSPGPTLEVSVWDLPPDADVSDADDRHFLGGLC

SEQ ID NO: 367 - protein, 81 aa, Artificial Sequence
  Synthetically generated peptide
VFIRVVKARSLPTSGSPVTKISLSGTMIQSKPARKTSCFEWDQTFAFLRDSPDLSSSPILEISVWDSSTGIETSQFLGGIC

SEQ ID NO: 368 - protein, 89 aa, Artificial Sequence
  Synthetically generated peptide
LEVHLVDAKGLTGNDFLGEIGKIDPYVVVQYRSQERKSSVARDQGKNPSWNEVFKFQINSTAATGQHKLFLRLMDHDTFSRDDFLGEAT

SEQ ID NO: 369 - protein, 63 aa, Artificial Sequence
  Synthetically generated peptide
MDPYVILTCRTQEQKSSVAKGAGSEPEWNETFVFTVSDDVPQLNVKIMDSDAFSADDFVGEAN

SEQ ID NO: 370 - protein, 82 aa, Artificial Sequence
  Synthetically generated peptide
LEVLLVCAKGLEDTDFLNDMDPYVILTCRTQEQKSSVAKGAGSEPEWNETFVFTVSDDVPQLNVKIMDSDAFSADDFVGEAN

SEQ ID NO: 371 - protein, 81 aa, Artificial Sequence
  Synthetically generated peptide
LEVLLVSAKGLEDTDFLNNMDPFVILTCRTQEQKSSVANGAGSEPEWNETFVFTVSDDTPQLHLKIMDSDLTNDDFVGERT

SEQ ID NO: 372 - protein, 81 aa, Artificial Sequence
  Synthetically generated peptide
LEVLLVSAKGLEDTDFLNNMDPFVILTCRTQEQKSSVANGAGSEPEWNETFVFTVSDDTPQLHLKIMDSDLTNDDFVGEAT

SEQ ID NO: 373 - protein, 82 aa, Artificial Sequence
  Synthetically generated peptide
LEVVLVSAKGLEDADFLNNMDPYVQLTCRTQDQKSNVAEGMGTTPEWNETFIFTVSEGTTELKAKIFDKDVGTEDDAVGEAT

SEQ ID NO: 374 - protein, 82 aa, Artificial Sequence
  Synthetically generated peptide
LEVLLVGAKGLENTDYLCNMDPYAVLKCRSQEQKSSVASGKGSDPEWNETFMFSVTHNATELIIKLMDSDSGTDDDFVGEAT

SEQ ID NO: 375 - protein, 82 aa, Artificial Sequence; identical to SEQ ID NO: 374
  Synthetically generated peptide

SEQ ID NO: 376 - protein, 82 aa, Artificial Sequence
  Synthetically generated peptide
LEVLLVGAKGLENTDYLCNMDPYAILKCRSQEQRSSIASGKGSNPEWNENFVFTVSDKATELLIKLLDSDTGSADDFVGEAT

SEQ ID NO: 377 - protein, 82 aa, Artificial Sequence
  Synthetically generated peptide
LEVVLISAKGLEDNDFLSSIDPYVILSYRAQEHKSTVQEGAGSNPQWNETFLFTVSDSASELNLRIMEKDNFNNDDNLGEAI

SEQ ID NO: 378 - protein, 87 aa, Artificial Sequence
  Synthetically generated peptide
MEVHLISGKGLQAHDPLNKPIDPYAEINFKGQERMSKVAKNAGPNPLWDEKFKFLAEYPGSGGDFHILFKVMDHDAIDGDDYIGDVK

SEQ ID NO: 379 - protein, 87 aa, Artificial Sequence; identical to SEQ ID NO: 378
  Synthetically generated peptide

SEQ ID NO: 380 - protein, 87 aa, Artificial Sequence; identical to SEQ ID NO: 378
  Synthetically generated peptide

SEQ ID NO: 381 - protein, 87 aa, Artificial Sequence
  Synthetically generated peptide
MEVHLISGKGLQAHDPLNKPIDPYAEINFKGQERMSKVAKNAGPDPIWNEKFKFLVEYPGSGGDFHILFKVMDHDAIDGDDYIGDVK

SEQ ID NO: 382 - protein, 87 aa, Artificial Sequence; identical to SEQ ID NO: 381
  Synthetically generated peptide

SEQ ID NO: 383 - protein, 87 aa, Artificial Sequence; identical to SEQ ID NO: 381
  Synthetically generated peptide

SEQ ID NO: 384 - protein, 87 aa, Artificial Sequence
  Synthetically generated peptide
MEVHLISGKGLQALDPLNKPIDPYAEINFKGQERMSKVAKNAGPDPIWNEKFKFLVEYPGSGGDFHILFKVMDHDAIDGDDYIGDVI

SEQ ID NO: 385 - protein, 87 aa, Artificial Sequence
  Synthetically generated peptide
LEVHLISGKGLQAHDPLNKPIDPYVEINYKGQERMSKVAKNAGPDPLWDEKFKFLAEYPGSGGDFHVLFKVMDHDAIDGDDYIGDVK

SEQ ID NO: 386 - protein, 87 aa, Artificial Sequence
  Synthetically generated peptide
LEVHLISGKGLQAHDPLNKPIDPYVEINYKGQERMSKVAKNAGPDPLWDEKFKFLAEYPGSGGDFHILFKVMDHDVIDGDDYIGDVK

SEQ ID NO: 387 - protein, 87 aa, Artificial Sequence
  Synthetically generated peptide
LEVHLISGKGLQAHDPLNKPIDPYAEINYKGQERMSKVAKNAGPDPLWDEKFKFLAEYPGSGGDFHIFFKVMDHDAIDDDDLIGEVK

SEQ ID NO: 388 - protein, 87 aa, Artificial Sequence
  Synthetically generated peptide
LEVHLISGKGLQAHDPLNKPIDPYVEINYKGQERMSKVAKNAGPDPVWNEKFKFLAEYPGSGGDFLILFKVMDHDVIDGDDYIGDVS

SEQ ID NO: 389 - protein, 87 aa, Artificial Sequence
  Synthetically generated peptide
LEVHLISGKGLRAHDPLNKPIDPYVEINYKGQERMSKVAKNAGPDPVWNEKFKFLAEYPGSGGDFLILFKVMDHDVIDGDDYIGDVS

SEQ ID NO: 390 - protein, 87 aa, Artificial Sequence
  Synthetically generated peptide
LEVSLISGKGLKRSDFLGKIDPYVEIQYKGQTRKSSVAKEDGGRNPTWNDKLKWRAEFPGSGADYKLIVKVMDHDTFSSDDFIGEAT

SEQ ID NO: 391 - protein, 77 aa, Artificial Sequence
  Synthetically generated peptide
VGCQKLKDTEWFSRQDPYVVLEYGGRSHRTRTCTDGGKNAVFQEKFIFTLIEGLRDLKVAVWNSNTLSTDDFIGNAT

SEQ ID NO: 392 - protein, 82 aa, Artificial Sequence
  Synthetically generated peptide
LEVTVVGCQKLKDTEWFSRQDPYVVLEYGGRSHRTRTCTDGGKNAVFQEKFIFTLIEGLRDLKVAVWNSNTLSTDDFIGNAT

SEQ ID NO: 393 - protein, 82 aa, Artificial Sequence
  Synthetically generated peptide
VDCTLVSARGIKDVEIVGKQSPYAVLTVGPKTFKSGTANGGGSDPVWNQTFSFTNVTPDSSVKLEIFNSNVVLRDVAIGGCK

SEQ ID NO: 394 - protein, 104 aa, Artificial Sequence
  Synthetically generated peptide
LRASVIEAHDLRVPAPSPGLPFDVRVKIKIGFQSARTQRSVASTSSGSAFAWEWEEDLMFVVSEPLDESLIVLVKDRTMIKEPARRGARPTSALLPAKEAAHVC

SEQ ID NO: 395 - protein, 88 aa, Artificial Sequence
  Synthetically generated peptide
LRASVIEAQDLRVPAPPPGLPFDVRVKIQVGFQSARTRRSVASRSSGSAFAWEEDLMFVVSEPLDESLVVLVEDRSMIKEPALLGHAT

SEQ ID NO: 396 - protein, 87 aa, Artificial Sequence
  Synthetically generated peptide
LRVTVLEAQDLHIAPNLPPLTAPEIRVKAQLGFQSARTRRGSMNNHSGSFHWHEDMIFVAGEPLEDCLVLMVEDRTTKEATLLGHAM

SEQ ID NO: 397 - protein, 87 aa, Artificial Sequence; identical to SEQ ID NO: 396
  Synthetically generated peptide

SEQ ID NO: 398 - protein, 83 aa, Artificial Sequence
  Synthetically generated peptide
LRVNVIEAQDLVLLHPNRINPEILIKGFLGNVVVRSRISQTKSVSPVWNEDMMFVAVEPFDDSLILSVEDKVGPREECLGRCE

SEQ ID NO: 399 - protein, 94 aa, Artificial Sequence
  Synthetically generated peptide
LRLSVIQAQDLRLPAPPDAKAKPMGPAFPELYVKAQLGAQVFKTCRVALGSAATGTSNPSWNEDLLFVAAEPFDPFLTVVVEDIFSGQPVGQAR

SEQ ID NO: 400 - protein, 93 aa, Artificial Sequence
  Synthetically generated peptide
LRLTVIQTQDLQLGLGSEAKSKIPTTELYVKAQLGPQVFKTARTSIGPSASSSGSGNPTWNEDLVFVASEPFEPFLIVTVEDITNGQSIGQTK

SEQ ID NO: 401 - protein, 84 aa, Artificial Sequence
  Synthetically generated peptide
LRATVIEAQDLLPPQLTAFKEASFQLKAQLGSQVQKTKSAVTRNGAPSWNEDLLFVAAEPFSDQLVFTLEYRTSKGPVTVGMAR

SEQ ID NO: 402 - protein, 76 aa, Artificial Sequence
  Synthetically generated peptide
LRISVLEAQDVVPGAVAGAGGDKGRHGEAFVVVKVQVGGVTLRTKPCCRPTSPSWNEELVFVVAEPFDEPAVLVIE

SEQ ID NO: 403 - protein, 96 aa, Artificial Sequence
  Synthetically generated peptide
LRISVIEAQDVAIMDKGSSLMRFPELSAKLQVGSQILRTAIASAIPTKSFSNPYWNEDLMFVVAEPFEDCVTVVVEDRLNGGAIGGQNDVAVGRVQ

SEQ ID NO: 404 - protein, 82 aa, Artificial Sequence
  Synthetically generated peptide
VRVNVIGAQDIFPMENHIPDVFVKVRLGHQMLKTRPARSPTRNFMWNEEMMFVAAEPFEEDLIIQIEDRVAQNKDEVIGETM

SEQ ID NO: 405 - protein, 81 aa, Artificial Sequence
  Synthetically generated peptide
LRVNVIEAQDLVIVPDRTRLPNPYVKIRLNNQVVRTKPSHSLNPRWNEEFTLVAAEPFEDLIISIEDRVAPNREETLGEVH

SEQ ID NO: 406 - protein, 72 aa, Artificial Sequence
  Synthetically generated peptide
LRVKVIEAHDLVSHDNKSRAPDAFVKVQHGNQIFKTKPVQSRINNPRWDQGTLFVAAEPFEEPLIITVEDKD

SEQ ID NO: 407 - protein, 83 aa, Artificial Sequence
  Synthetically generated peptide
LRVNVIEAQDVISSDRNRVPEVFIKAQMGSQVLRTKVCPTRSTTQIWNEDLVFVAAEPFEEQLTITVEDRVHGSKDEVLGKIM

SEQ ID NO: 408 - protein, 83 aa, Artificial Sequence
  Synthetically generated peptide
LRVNVIEAQDVIPSDRNRLPEVSVKAHLGCQVLKTKICSTRTTSPLWNEDLVFVAAEPFEEQLTITVEDHVQPSKDEVLGRIS

SEQ ID NO: 409 - protein, 83 aa, Artificial Sequence
  Synthetically generated peptide
LRVNVIEAQDMIPSDRNRLPDVFVKASVGMQTLKTSICSIKTTNPLWKEDLVFVVAEPFEEQLVISVEDRVHTSKDEVIGKIT

SEQ ID NO: 410 - protein, 83 aa, Artificial Sequence
  Synthetically generated peptide
LRVNVIEAQDVEPSDRSQPPQAFVKVQVGNQILKTKLCPNKTTNPMWNEDLVFVAAEPFEEQFFLTVENKVTPAKDEVMGRLI

SEQ ID NO: 411 - protein, 83 aa, Artificial Sequence; identical to SEQ ID NO: 410
  Synthetically generated peptide

SEQ ID NO: 412 - protein, 83 aa, Artificial Sequence
  Synthetically generated peptide
LRVNVIEAQDVQPQARGRAPEVFVKAQVGNQILKTSVVAAPTLNPRWNEDLVFVVAEPFEEQLLLTVEDRVTPRKDDLLGRAA

SEQ ID NO: 413 - protein, 83 aa, Artificial Sequence
  Synthetically generated peptide
LRVNIIEAQDIAITDKTRYPDVFVRAQVGHQHGRTKPVQARNFNPFWNEDLMFVAAEPFEDHLILSLEDRVAPNKDEVLGRVI

SEQ ID NO: 414 - protein, 83 aa, Artificial Sequence; identical to SEQ ID NO: 413
  Synthetically generated peptide

SEQ ID NO: 415 - protein, 83 aa, Artificial Sequence
  Synthetically generated peptide
LRVNVIEAQDLIPTDKQRYPEVYVKAIVGNQALRTRVSQSRTINPMWNEDLMFVAAEPFEEPLILSVEDRVAPNKDEVLGRCA

SEQ ID NO: 416 - protein, 83 aa, Artificial Sequence; identical to SEQ ID NO: 415
  Synthetically generated peptide

SEQ ID NO: 417 - protein, 83 aa, Artificial Sequence
  Synthetically generated peptide
LRVNVIEAQDLIPSDKGRYPEVFVKVIMGNQALRTRVSQSRSINPMWNEDLMFVVAEPFEEPLILSVEDRVAPNKDEVLGRCA

SEQ ID NO: 418 - protein, 83 aa, Artificial Sequence
  Synthetically generated peptide
VRVNVIEAQDLIPHDKTKFPEVYVKAMLGNQTLRTRISQTKTLNPMWNEDLMFVVAEPFEEALILAVEDRVAPNKDETLGRCA

SEQ ID NO: 419 - protein, 83 aa, Artificial Sequence
  Synthetically generated peptide
LRVNVIEAQDLIPNDRTRFPDVYVKAMLGNQALRTRVSPSRTLNPMWNEDLMFVAAEPFEEHLILSVEDRIAPGKDDVLGRTI

SEQ ID NO: 420 - protein, 81 aa, Artificial Sequence
  Synthetically generated peptide
VRVNVIEAQDLIPTDKTRFPDVYVKAQLGNQVMKWCQARTLGAVWNEDFLFVVAEPFEDHLVLTVEDRVAPGKDEIVGRTY

SEQ ID NO: 421 - protein, 81 aa, Artificial Sequence; identical to SEQ ID NO: 420
  Synthetically generated peptide

SEQ ID NO: 422 - protein, 92 aa, Artificial Sequence
  Synthetically generated peptide
LRVSVIEAQDLIPMDKGPMAIGRYPELFVRAQVGSQMLRTRPAPVAANRGPSSPFWNEDLMFVVAEPFEEFLVLSLEDHVSPGRDDVLGRLV

SEQ ID NO: 423 - protein, 68 aa, Artificial Sequence
  Synthetically generated peptide
DKSRVPEVFVRVKVGNQMLRTKFPQRSNNPKWGDEFTFVVAEPFEDNLVLSVEDHTAPNRDEPVGKAV

SEQ ID NO: 424 - protein, 83 aa, Artificial Sequence
  Synthetically generated peptide
LRVQILEAQDVIIVSDKSRVPEVFVRVKVGNQMLRTKFPQRSNNPKWGDEFTFVVAEPFEDNLVLSVEDHTAPNRDEPVGKAV

SEQ ID NO: 425 - protein, 83 aa, Artificial Sequence
  Synthetically generated peptide
LRIHVMEAQDLVPSDKGRVPDAIVKIQAGNQMRATRTPQMRTMNPQWHEELMFVVSEPFEDMVIVSVDDRIGPGKDEILGRVF

SEQ ID NO: 426 - protein, 83 aa, Artificial Sequence; identical to SEQ ID NO: 425
  Synthetically generated peptide

SEQ ID NO: 427 - protein, 82 aa, Artificial Sequence
  Synthetically generated peptide
LKVVAIAAQDLIPAEKGRPLAPSIVKIQLGGQTRRTRSQGSANPMWNEEFLFVAAEPFDEPLVVTVEERVAAGRDEPVGRVI

SEQ ID NO: 428 - protein, 84 aa, Artificial Sequence
  Synthetically generated peptide
LRVAAIGAQDLVPLDASRPANFCVKLQLAGQVRRTRPGAPPGTLNPIWNEEFMFVVSEPFDEPLFVTVEDRVGPGRDEPLGRIM

SEQ ID NO: 429 - protein, 82 aa, Artificial Sequence
  Synthetically generated peptide
VRVTIVSGHDLISTDRNRTPSVYVTATLGQVTLKTEVSSGTNPSWNKDLIFVASEPLEGTVYIRLIDRVDDQHEERIIGKLE

SEQ ID NO: 430 - protein, 81 aa, Artificial Sequence
  Synthetically generated peptide
VRVTIVSGHDLISKDKNKTPSVYVTATLGKVALKTKVSSGTNPSWNQDLIFVASEPLEGTVYIRLIDREDEQHEGCIGTLK

SEQ ID NO: 431 - protein, 79 aa, Artificial Sequence
  Synthetically generated peptide
IIVTVLAGKNLVSKDKSGKCDASVKLQYGKIIQKTKIVNAAECVWNQKFEFEELAGEEYLKVKCYREEMLGTDNIGTAT

SEQ ID NO: 432 - protein, 79 aa, Artificial Sequence; identical to SEQ ID NO: 431
  Synthetically generated peptide

SEQ ID NO: 433 - protein, 100 aa, Artificial Sequence
  Synthetically generated peptide
IYVTVVSGNNLNRRILRGSPSKSSEIGEGSSGNSSSKPVQTFVEVELEQLSRRTEMKSGPNPAYQSTFNMILHDNTGTLKFNLYENNPGSVRYDSLASCE

SEQ ID NO: 434 - protein, 100 aa, Artificial Sequence; identical to SEQ ID NO: 433
  Synthetically generated peptide

SEQ ID NO: 435 - protein, 82 aa, Artificial Sequence
  Synthetically generated peptide
VKLEILEGSDMKPSDMNGLSDPYVKGRLGPFKFQTQIQKKTLSPKWFEEFKIPITSWESLNELAMEVCDKDHMFDDSLGTCT

SEQ ID NO: 436 - protein, 82 aa, Artificial Sequence
  Synthetically generated peptide
AKVEILEGADMKPSDPNGLADPYVKGHLGPYRFQTKIHKKTLNPKWMEEFKIPVTSWAALNLLSLQVRDKDPIFDDTLGDCS

SEQ ID NO: 437 - protein, 82 aa, Artificial Sequence
  Synthetically generated peptide
ALVEVVEACDVKPSDLNGLADPYVKGQLGAYRFKTKILWKTLAPKWQEEFKIPICTWDSANILNIEVQDKDRFSDDSLGDCS

SEQ ID NO: 438 - protein, 82 aa, Artificial Sequence; identical to SEQ ID NO: 437
  Synthetically generated peptide

SEQ ID NO: 439 - protein, 82 aa, Artificial Sequence
  Synthetically generated peptide
VLVEVFEASDLKPSDLNGLADPYVKGKLGAYRFKTKIQKKTLSPKWHEEFKIPIFTWDSPSILNIEVGDKDRFVDDTLGECS

SEQ ID NO: 440 - protein, 82 aa, Artificial Sequence; identical to SEQ ID NO: 439
  Synthetically generated peptide

SEQ ID NO: 441 - protein, 82 aa, Artificial Sequence
  Synthetically generated peptide
VLVEVFEASDLKPSDLNGLADPYVKGKLGAYRFKTKIQKKTLSPKWHEEFKIPIFTWDSPSILNIEVGDKDRFVDDTLGFAP

SEQ ID NO: 442 - protein, 80 aa, Artificial Sequence
  Synthetically generated peptide
LCVHVLEARLQAAYLTGHSDPYVRLQMGRRRAKTTVVKRCLSPLWDEEFGFAVGDAEEELVVSVLNEEGYFGGGFLGRVK

SEQ ID NO: 443 - protein, 81 aa, Artificial Sequence
  Synthetically generated peptide
LQVRVVEARGLPAVRVDGTSDPFVKLQLGKRRAKTAVARRTLAPAWDEEFSFLVGDIAEELVVSVLNEDKYFSNDLLGKVR

SEQ ID NO: 444 - protein, 81 aa, Artificial Sequence
  Synthetically generated peptide
LQVRVVEARNLPAMDLNGFSDPYVRLQLGKQRSRTKVVKKNLNPKWTEDFSFGVDDLNDELVVSVLDEDKYFNDDFVGQVR

SEQ ID NO: 445 - protein, 81 aa, Artificial Sequence
  Synthetically generated peptide
LNVRVIEARNLRAMDSNGFSDPYVKLQLGKQRFKTKVVKKNLNPAWDQEFSFSVGDVRDVLKLYVYDEDMIGIDDFLGQVK

SEQ ID NO: 446 - protein, 82 aa, Artificial Sequence
  Synthetically generated peptide
LLVQVSEARNLPAIDGGGGLSDPYAKLQLGRQRGKTRVAKRTLSPTWDEEFAFRVVDLKDELVVVVVDEDRYFSDDFLGQVR

SEQ ID NO: 447 - protein, 65 aa, Artificial Sequence
  Synthetically generated peptide
LCVSVIEARNVQADDFAGKNFYVKLRVGSNEVKTDVVKGSLAPKFLKDCRLAVPTPESDYLRIEL

SEQ ID NO: 448 - protein, 81 aa, Artificial Sequence
  Synthetically generated peptide
VKVELLAAKNLIGANLNGTSDPYAIVNCGSEKRFSSMVPGSRNPMWGEEFNFPTDELPAKINVTIHDWDIIWKSTVLGSVT

SEQ ID NO: 449 - protein, 81 aa, Artificial Sequence; identical to SEQ ID NO: 448
  Synthetically generated peptide

SEQ ID NO: 450 - protein, 81 aa, Artificial Sequence
  Synthetically generated peptide
VKLELLAAKNLIAANLNGTSDPYALITCGEEKRFSSMVPGSRNPMWGEEFNFFVDSLPVKINVTIYDWDIVWKSTVLGSVI

SEQ ID NO: 451 - protein, 91 aa, Artificial Sequence
  Synthetically generated peptide
IKLELLCAKYLIGANLNGSSDPYAVISCGEQRRFSSMVPSSRNPLWGEEFNFLVRELPVEFCTAPVNDSKVTITMYDWDTVCKCKVIGSVT

SEQ ID NO: 452 - protein, 31 aa, Artificial Sequence
  Synthetically generated peptide
LEVHLLEAHGLLDTDTFGKSDPYAIVYCQKE

SEQ ID NO: 453 - protein, 79 aa, Artificial Sequence
  Synthetically generated peptide
IELVLVEARDLVAADIRGTSDPYVRVQYGEKKQRTKVIYKTLQPKWNQTMEFPDDGSSLELHVKDYNTLLPTSSIGNCV

SEQ ID NO: 454 - protein, 79 aa, Artificial Sequence; identical to SEQ ID NO: 453
  Synthetically generated peptide

SEQ ID NO: 455 - protein, 83 aa, Artificial Sequence
  Synthetically generated peptide
LVVIVHEAQDVEGKHHTNPQARLIFRGEEKKTKRIKKNRDPRWEDEFQFIAEEPPTNDKLHVEVVSSSSRTLLHQKESLGYVD

SEQ ID NO: 456 - protein, 83 aa, Artificial Sequence
  Synthetically generated peptide
LVVIVHEAQDVEGKHHTNPYVRIVFRGEERKTKHIKKNRDPRWEQEFQFVCEEPPINDKMQIEVISRPPSIGIHSKENLGYVV

SEQ ID NO: 457 - protein, 82 aa, Artificial Sequence
  Synthetically generated peptide
LVVIVHEAEDLEGKYHTNPSVRLLFRGEERKTKRVKKNREPRWDEDFQFPLDEPPINDKLHVEVISSSSRLIHPKETLGYVV

SEQ ID NO: 458 - protein, 65 aa, Artificial Sequence
  Synthetically generated peptide
FVVIVHSAEDVEGKHHTNPYVHIYFKGEERKTKHVKKNKDPKWNEEFSFMLEEPPIHEKMHVKVF

SEQ ID NO: 459 - protein, 65 aa, Artificial Sequence; identical to SEQ ID NO: 458
  Synthetically generated peptide

SEQ ID NO: 460 - protein, 65 aa, Artificial Sequence
  Synthetically generated peptide
LVVIVHSAEDVEGKHHTNPYVHIYFKGEERKTKNVKKNKDPKWNEEFSFMLEEPPVHEKLHVEVF

SEQ ID NO: 461 - protein, 84 aa, Artificial Sequence
  Synthetically generated peptide
  misc_feature (58)..(58): Xaa can be any naturally occurring amino acid
LAVIVHSAEDVEGKHHTNPYVRIYFKGEERKTKHVKKNRDPRWEEEFTFMLEEPPVRXKLHVEVLSTSSRIGLLHPKETLGYVD

SEQ ID NO: 462 - protein, 84 aa, Artificial Sequence
  Synthetically generated peptide
LVVIVHSAEDVEGKHHTNPYVRIYFKGEERKTKHVKKNRDPRWNEEFTFMLEEPPVREKLHVEVLSTSSRIGLLHPKETLGYVD

SEQ ID NO: 463 - protein, 84 aa, Artificial Sequence
  Synthetically generated peptide
LYVVVHEAQDLEGKHHTNPYAKIIFKGEEKKTKVIKKNRDPRWEDEFEFVCEEPPVNDKLHIEVLSKASKKGLIHGKETLGYID

SEQ ID NO: 464 - protein, 64 aa, Artificial Sequence
  Synthetically generated peptide
LYVVVHEAKELEGKCNTNPYVKLTFKGVEKKTKVVKENRNPRWKEEFEFECEETPANDKLHVEV

SEQ ID NO: 465 - protein, 84 aa, Artificial Sequence
  Synthetically generated peptide
LSVAVQSAKDVEGKKKHSNPYAVVLFRGEKKKTKMLKKTRDPRWNEEFQFTLEEPPVKESIRVEVMSKGTGFHFRSKEELGHVD

SEQ ID NO: 466 - protein, 84 aa, Artificial Sequence; identical to SEQ ID NO: 465
  Synthetically generated peptide

SEQ ID NO: 467 - protein, 84 aa, Artificial Sequence; identical to SEQ ID NO: 465
  Synthetically generated peptide

SEQ ID NO: 468 - protein, 85 aa, Artificial Sequence
  Synthetically generated peptide
LLVSVENAEDVEGKRHTNPYAVVHFRGERKETKIIKKTRDPRWNEEFQFMVDEAPVDDKIHIEVVSKRRGLRLPFRNKESLGHVD

SEQ ID NO: 469 - protein, 87 aa, Artificial Sequence
  Synthetically generated peptide
LGVEVASAHDLMPKDGQGSASACVELTFDGQRFRTAIKDKDLNPVWNERFYFNVSDPSNLPELALEAYVYNINRSIDGSRSFLGKVR

SEQ ID NO: 470 - protein, 87 aa, Artificial Sequence
  Synthetically generated peptide
LGVEVASAHDLMPKDGQGSASACVELTFDGQRFRTAIKDKDLNPVWNERFYFNVSDPSNLPELALEAYVYNINRSVDGSRSFLGKVR

SEQ ID NO: 471 - protein, 86 aa, Artificial Sequence
  Synthetically generated peptide
LGVDVIGAHNLFPKDGQGTSNAYVELYFDGQKHRTTIKDRDLNPVWNESFFFNISDPSRLHYLNLEAQAYSHNRSTNGRSFLGKVS

SEQ ID NO: 472 - protein, 86 aa, Artificial Sequence; identical to SEQ ID NO: 471
  Synthetically generated peptide

SEQ ID NO: 473 - protein, 85 aa, Artificial Sequence
  Synthetically generated peptide
LGVEVTSAHDLLPKEQGTCNPYVEIEFDDQKFRTAIKERDINPVWNEQFYFNISDPSRLTEKDLEAYVYHANRASNSKTCLGKVR

SEQ ID NO: 474 - protein, 86 aa, Artificial Sequence
  Synthetically generated peptide
LCVEVVGAHDLVAKDGEGSSTTFVELEFDDQKFRTTTKDKDLSPYWNEIFYFNITDPSKLSNLNLEACINHYNKTNGSKIPLGKVK

SEQ ID NO: 475 - protein, 59 aa, Artificial Sequence
  Synthetically generated peptide
LGVEVISAQGLLQRDKHNSCSPFVELKFDNQIFRATTKHNDPNPVWHECFYFVVSDPSV

SEQ ID NO: 476 - protein, 86 aa, Artificial Sequence
  Synthetically generated peptide
LGVEVISAQGLLQRDKHNSCSPFVELKFDNQIFRATTKHNDPNPVWHECFYFVVSDPSVLSTRTLEAHVYSYQNEFDAKPFLGKVR

SEQ ID NO: 477 - protein, 84 aa, Artificial Sequence
  Synthetically generated peptide
LGVEVISARLKPREDYGGVNAYVELRFDDQKVITMTKIDDSSPVWNEKFFFNISDTEDLSNQFLDAYVYNKTSSITKSCLGKIR

SEQ ID NO: 478 - protein, 84 aa, Artificial Sequence
  Synthetically generated peptide
LVVEVISADIPSSSNTSQTNYSVELHFNSQSKSTTIKENVAVWNERFSFDMRQREDPSGNLILEAAVYCFDQMSNSKSLLGKVL

SEQ ID NO: 479 - protein, 94 aa, Artificial Sequence
  Synthetically generated peptide
VVVEVCNARNLMPKDGQGTASAYAVVDFDGQRRRTATRPRDLNPQWGERLEFLVHDPDAMCAETLELNLYNDKKAIAATGGGGRRGGTFLGKVK

SEQ ID NO: 480 - protein, 86 aa, Artificial Sequence
  Synthetically generated peptide
LIVEICSARNLMPKDGQGTASAYAIVDFDGQRRRTKTKFRDLNPQWDEKLEFFVHDVATMGEEILEINLCNDKKTGKRSTFLGKVK

SEQ ID NO: 481 - protein, 90 aa, Artificial Sequence
  Synthetically generated peptide
LVVEVVEARNILPKDGQGSSSAYVVVDFDAQKKRTSTKFRDLNPIWNEMLDFAVSDPKNMDYDELDIEVYNDKRFGNGGGRKNHFLGRVK

SEQ ID NO: 482 - protein, 90 aa, Artificial Sequence; identical to SEQ ID NO: 481
  Synthetically generated peptide

SEQ ID NO: 483 - protein, 95 aa, Artificial Sequence
  Synthetically generated peptide
LAVEVVDARDLVPKDGLGTSSAFAVVDFDGQRKRTRTVPRDLSPQWHERLEFAVHDPAAMHAEALDVSLYHDRRFNPSGGGGGGGGKNHFLGRVR

SEQ ID NO: 484 - protein, 87 aa, Artificial Sequence
  Synthetically generated peptide
LIVEVINAHDLMPKDGEGSASTFVEVDFENQLSRTRTVPKNLNPTWNQKLVFNLDTTKPYHHKTIEVSVYNDRRQPNPGRNFLGRVR

SEQ ID NO: 485 - protein, 87 aa, Artificial Sequence
  Synthetically generated peptide
LVVHVVDAQYLMPRDGQGSASPFVEVDFLNQLSKTRTVPKSLNPVWNQKLYFDYDQSVINQHNQHIEVSVYHERRPIPGRSFLGRVK

SEQ ID NO: 486 - protein, 97 aa, Artificial Sequence
  Synthetically generated peptide
LVVEVVAAHNLMPKDGQGSSSAYVEVEFEHQRRRTRARPKELNPVWNERLVFAVADPDDLPYRAIDVGVYNDRAASGGVAGGGGAAPHGRNFLGKVR

SEQ ID NO: 487 - protein, 86 aa, Artificial Sequence
  Synthetically generated peptide
LVVEIVGAHNLMPKDGEDSSSPFVEVQFENQRLRTKVKPKDLNPIWNEKLVFHVIDVNDLRHKALEINVYNEKRSSNSRNFLGKVR

SEQ ID NO: 488 - protein, 86 aa, Artificial Sequence
  Synthetically generated peptide
LVVEIVDASDLMPKDGQGSASPFVEVEFDEQRQRTQTRFKDLNPQWNEKLVFNVGDLKRLNNKTVDVTVYDDRRDNQPGKFLGRVK

SEQ ID NO: 489 - protein, 91 aa, Artificial Sequence
  Synthetically generated peptide
VGVEILDASELAPKDGAGACNAFVEVEFDGQKQRTPTKPADRSPQWNHTLVFDVRDPSRLPSLPVDVSVHHDRSLTDHHATRLHTFLGRVR

SEQ ID NO: 490 - protein, 90 aa, Artificial Sequence
  Synthetically generated peptide
LVVEVVDAKDLTPKDGHGTSSPYVVLDYYGQRRRTRTIVRDLNPVWNETLEFSLAKRPSHQLFTDVLELDMYHDKNFGQTRRNNFLGRIR

SEQ ID NO: 491 - protein, 82 aa, Artificial Sequence
  Synthetically generated peptide
LNVRVVRGSNLAICDPLTHTSDPYVVLHYGAQKVKTSVQKKNPNPVWNEVLQLSVTNPTKPVHLEVFDEDKFTADDSMGVAE

SEQ ID NO: 492 - protein, 82 aa, Artificial Sequence
  Synthetically generated peptide
LNVRVVRGSNLIIADPLTHTSDPYVVLSYGPQKVKTSVQKKNSNPVWNEVLQLAVTNPTKPVKLEVFDEDKFTADDSMGVAE

SEQ ID NO: 493 - protein, 82 aa, Artificial Sequence
  Synthetically generated peptide
LKVRVMRGLNLAICDPLTHSSDPYVVLRHGSQKVKSSIRYHSINPEWNEELTLSITNMMLPVKIEVFDKDTFTKDDSMGDAE

SEQ ID NO: 494 - protein, 80 aa, Artificial Sequence
  Synthetically generated peptide
LKIRVVRGINLAYRDTRGSDPYVVLRLGKQKVKTSVKKKSVNPIWHEELTLSIMNPIAPIKLGVFDKDTFSRDDPMGDAE

SEQ ID NO: 495 - protein, 80 aa, Artificial Sequence
  Synthetically generated peptide
LSVRVLRGVNLVSRDAGGSDPYVVLHLDNQKLKTGVVKKTTNPVWNEELTLAVRNPETPIQLEVFDKDTFSKDDQMGDAE

SEQ ID NO: 496 - protein, 79 aa, Artificial Sequence
  Synthetically generated peptide
VKVRVVRGVNLAVRDLRSSDPYVIVRMGKQKLKTRVIKKTTNPEWNDELTLSIEDPAVPVRLEVYDKDTFIDDAMGNAE

SEQ ID NO: 497 - protein, 80 aa, Artificial Sequence
  Synthetically generated peptide
LRIRVKRGINLAQRDTLGSDPFVVITMGSQKLKTRVVENNCNPEWNEELTLALRHPDEPVNLIVYDKDTFTSHDKMGDAK

SEQ ID NO: 498 - protein, 80 aa, Artificial Sequence
  Synthetically generated peptide
LRIRVKRGINLAQRDTLSSDPFVVITMGSQKLKTRVVENNCNPEWNEELTLALRHPDEPVNLIVYDKDTFTSHDKMGDAK

SEQ ID NO: 499 - protein, 32 aa, Artificial Sequence
  Synthetically generated peptide
LRIRVKRGINLAQRDTLSSDPFVVITMGSQVF

SEQ ID NO: 500 - protein, 80 aa, Artificial Sequence
  Synthetically generated peptide
VRILVKRGIDLARRDALSSDPFVVITMGPQKLKSFTVKNNCNPEWNEELTLAIEDPNEPVKLMVYDKDTFTADDKMGDAQ

SEQ ID NO: 501 - protein, 80 aa, Artificial Sequence
  Synthetically generated peptide
LRIRVKRGINLVSRDSNTSDPFVVVTMGSQKLKTRGVENSCNPEWDDELTLGINDPNQHVTLEVYDKDTFTSHDPMGDAE

SEQ ID NO: 502 - protein, 80 aa, Artificial Sequence
  Synthetically generated peptide
LRVHVKRGINLAIRDATTSDPYVVITLANQKLKTRVINNNCNPVWNEQLTLSIKDVNDPIRLTVFDKDRFSGDDKMGDAE

SEQ ID NO: 503 - protein, 80 aa, Artificial Sequence
  Synthetically generated peptide
LTIHVKRGINLAIRDHRSSDPYIVLNVADQTLKTRVVKKNCNPVWNEEMTVAIKDPNVPIRLTVFDWDKFTGDDKMGDAN

SEQ ID NO: 504 - protein, 81 aa, Artificial Sequence
  Synthetically generated peptide
LKLRIKRGINLAIRDSNSSDPYVVVNIGHEQKLKTRVVKNNCNPEWNEELTLSIRDVRVPICLTVFDKDTFFVDDKMGDAE

SEQ ID NO: 505 - protein, 80 aa, Artificial Sequence
  Synthetically generated peptide
LRIRIKRGVNLAVRDISSSDPYVVVKMGKQKLKTRVINKDVNPEWNEDLTLSVTDSNLTVLLTVYDHDMFSKDDKMGDAE

SEQ ID NO: 506 - protein, 80 aa, Artificial Sequence
  Synthetically generated peptide
LRIRIKRGVNLAVRDLNSSDPYVVVKMAKQKLKTRVIYKNVNPEWNEDLTLSVSDPNLTVLLTVYDYDTFTKDDKMGDAE

SEQ ID NO: 507 - protein, 80 aa, Artificial Sequence
  Synthetically generated peptide
LRIRIKRGVNLAVRDVNTSDPYAVVKMGKQRLKTHVIKKDVNPEWNEDLTLSITDPVVPFKLTVYDYDTFSKDDKMGDAE

SEQ ID NO: 508 - protein, 80 aa, Artificial Sequence
  Synthetically generated peptide
LRIHVKRGVNLAIRDISSSDPYIVVHCGKQKLKTRVVKHSVNPEWNDDLTLSVTDPNLPIKLTVYDYDLLSADDKMGEAE

SEQ ID NO: 509 - protein, 80 aa, Artificial Sequence
  Synthetically generated peptide
LRLHVIRGVNLAIRDSQSSDPYVIVRMGKQKLRTRVMKKNLNTEWNEDLTLSVTDPTLPVKIMVYDRDRFSRDDKMGDAI

SEQ ID NO: 510 - protein, 80 aa, Artificial Sequence
  Synthetically generated peptide
LRVRVQRGVNLAVRDVSSSDPYVVLKLGRQKLKTKVVKQNVNPQWQEDLSFTVTDPNLPLTLIVYDHDFFSKDDKMGDAE

SEQ ID NO: 511 - protein, 80 aa, Artificial Sequence
  Synthetically generated peptide
LKVTIKKGTNLAIRDMMSSDPYVVLNLGKQKLQTTVMNSNLNPVWNQELMLSVPESYGPVKLQVYDYDTFSADDIMGEAD

SEQ ID NO: 512 - protein, 80 aa, Artificial Sequence; identical to SEQ ID NO: 511
  Synthetically generated peptide

SEQ ID NO: 513 - protein, 80 aa, Artificial Sequence
  Synthetically generated peptide
LKVTIKKGTNMAIRDMMSSDPYVVLTLGQQKAQSTVVKSNLNPVWNEELMLSVPHNYGSVKLQVFDYDTFSADDIMGEAE

SEQ ID NO: 514 - protein, 80 aa, Artificial Sequence; identical to SEQ ID NO: 513
  Synthetically generated peptide

SEQ ID NO: 515 - protein, 80 aa, Artificial Sequence; identical to SEQ ID NO: 513
  Synthetically generated peptide

SEQ ID NO: 516 - protein, 80 aa, Artificial Sequence
  Synthetically generated peptide
LKVKVVKGTNLAIRDMRTSDPYVVLKLGQQTVQTTVIRSNLNPVWNEELMLSVPQQFGPISLEVFDHDLFSADDIMGEAQ

SEQ ID NO: 517 - protein, 80 aa, Artificial Sequence
  Synthetically generated peptide
LNVKVKGGTNLAIRDMSSSDPYVVLTLGQQKAQTSVIKANLNPVWNEELKLSVPQQYGPLKLQAFDHDMLSKDDLMGEAE

SEQ ID NO: 518 - protein, 80 aa, Artificial Sequence
  Synthetically generated peptide
LNVKVKGGTNLAIRDMSSSDPYVVLTLGQQKAQTSVIKANLNPVWNEELKLSVPQQYGPLKLQVFDHDMLSKDDLMGEAE

SEQ ID NO: 519 - protein, 80 aa, Artificial Sequence
  Synthetically generated peptide
IKVKVIRGTKLAVRDILSSDPYVVLTLGQQKAKTKVIKSNLNPVWNEVLTLSVPQKYGPLKLQVYDHDVLSRDDIMGEAE

SEQ ID NO: 520 - protein, 80 aa, Artificial Sequence
  Synthetically generated peptide
LNITVVRGIQLAVRDMLTSDPYVVLTLGEQKAQTTVKPSDLNPVWNEVLKISIPRNYGPLKLEVYDHDTFSADDIMGEAE

SEQ ID NO: 521 - protein, 80 aa, Artificial Sequence
  Synthetically generated peptide
IKVDIRRGTNLAVRDVMSSDPYVMLNLGHQTMKTKVIKNTLNPVWNERLMLSIPHPVPPLKLQVFDKDTFSSDDRMGDVE

SEQ ID NO: 522 - protein, 80 aa, Artificial Sequence
  Synthetically generated peptide
IKVNVIRGTNLAVRDMMSSDPYVILNLGHQSMKTKVIKSSLNPVWNERILLSIPDPIPMLKLQVYDKDTFTTDDRMGEAE

SEQ ID NO: 523 - protein, 80 aa, Artificial Sequence
  Synthetically generated peptide
IKVNVVKGTNLAVRDVMTSDPYVILALGQQSVKTRVIKNNLNPVWNETLMLSIPEPMPPLKVLVYDKDTFSTDDFMGEAE

SEQ ID NO: 524 - protein, 80 aa, Artificial Sequence; identical to SEQ ID NO: 523
  Synthetically generated peptide

SEQ ID NO: 525 - protein, 80 aa, Artificial Sequence
  Synthetically generated peptide
IKVNVRKGTHLAIRDVVTSDPYVILSLGHQSVKTRVIRNNLNPVWNESLMLSIPENIPPLKVLVYDKDTFSTDDFMGEAE

SEQ ID NO: 526 - protein, 80 aa, Artificial Sequence
  Synthetically generated peptide
LQVTVIQGKKLVIRDFKSSDPYVIVKLGNESAKTKVINNCLNPVWNEELNFTLKDPAAVLALEVFDKDRFKADDKMGHAS

SEQ ID NO: 527 - protein, 80 aa, Artificial Sequence
  Synthetically generated peptide
LQVTVIRGKKLAIRDFKSSDPYVIVKLGNESAKTKVINNCLNPVWDEELSFTLKDPAAVLSLEVFDKDRFKADDKMGHAT

SEQ ID NO: 528 - protein, 80 aa, Artificial Sequence
  Synthetically generated peptide
LKVIVVQGKRLVIRDFKTSDPYVVLKLGNQTAKTKVINSCLNPVWNEELNFTLTEPLGVLNLEVFDKDLLKADDKMGNAF

SEQ ID NO: 529 - protein, 80 aa, Artificial Sequence
  Synthetically generated peptide
LKVVVASGTNLAVRDFTSSDPYVVVRLAAMNKKTKVINSCLNPVWNEEMSFSIEEPAGVIKFEVFDWDRFKYDDKMGHAF

SEQ ID NO: 530 - protein, 80 aa, Artificial Sequence
  Synthetically generated peptide
VKVKVVRGTNLAVRDVFSSDPYVVLKLGNQEVRTRTVRKNTNPVWNEDLTLIVQDLNHLLVTLEVYDRDPFVDDPMGAAF

SEQ ID NO: 531 - protein, 94 aa, Artificial Sequence
  Synthetically generated peptide
LELGILGAQGIVPMKTRDGKGSSDTYCVAKYGSKWVRTRTIVNNPGPKFNEQYTWEVYDPATVLTVGVFDNGQLGEKGGEKTSSSKDAKIGKVR

SEQ ID NO: 532 - protein, 94 aa, Artificial Sequence; identical to SEQ ID NO: 531
  Synthetically generated peptide

SEQ ID NO: 533 - protein, 88 aa, Artificial Sequence
  Synthetically generated peptide
LELGILNAVGLHPMKTREGRGTSDTFCVGKYGQKWVRTRTMVDNLCPKYNEQYTWEVFDPATVLTVGVFDNGQLGEKGNRDVKIGKIR

SEQ ID NO: 534 - protein, 88 aa, Artificial Sequence; identical to SEQ ID NO: 533
  Synthetically generated peptide

SEQ ID NO: 535 - protein, 50 aa, Artificial Sequence
  Synthetically generated peptide
RTISNSLDPKYHEQYTWEVFDPATVLTVGVFDNCQVNGPDNKDLLIGKVR

SEQ ID NO: 536 - protein, 73 aa, Artificial Sequence
  Synthetically generated peptide
RDGRGAADVYCVAKYGHKWVRTRTIVGSLSPKFHEQYYWEVYDPSTVLTLGVFNNGQLNDSNDSNDSKIGKVR

SEQ ID NO: 537 - protein, 91 aa, Artificial Sequence
  Synthetically generated peptide
LEIGILSATGLMPMKVRDGKCGGIADSYCVAKYGPKWVRTRTVVDSLCPKWNEQYTWEVYDPCTVVTVGVFDNARVNENNNSRDVRIGKVR

SEQ ID NO: 538 - protein, 71 aa, Artificial Sequence
  Synthetically generated peptide
LVLGVISASGSIPMKSRDGRGTTDAYCVAKYGQKWVRTRTIVDSLSPKWSEQYTWEVYDPYTVITVAVFDN

SEQ ID NO: 539 - protein, 93 aa, Artificial Sequence
  Synthetically generated peptide
LELGVLNATGLMPMKSRGGRGTTDAYCVAKYGTKWVRTRTIVDTFDPKWNEQYTWEVYDPYTVITIGVFDNLKLFGAGNENRLINDSRIGKIR

SEQ ID NO: 540 - protein, 92 aa, Artificial Sequence
  Synthetically generated peptide
LELGILNATGLMPMKTKDGRGTTDAYCVAKYGQKWIRTRTIIDSFTPRWNEQYTWEVFDPCTVVTVGVFDNCHLHGGEKIGGAKDSRIGKVR

SEQ ID NO: 541 - protein, 92 aa, Artificial Sequence; identical to SEQ ID NO: 540
  Synthetically generated peptide

SEQ ID NO: 542 - protein, 94 aa, Artificial Sequence
  Synthetically generated peptide
LELGVLNATGLMPMKAKEGGRGTTDAYCVAKYGQKWIRTRTIIDSFTPRWNEQYTWEVFDPCTVVTVGVFDNCHLHGGDKNNGGGKDSRIGKVR

SEQ ID NO: 543 - protein, 92 aa, Artificial Sequence
  Synthetically generated peptide
LELGILTAQGLLPMKTKDGRGTTDAYCVAKYGQKWVRTRTIIDSFTPKWNEQYTWEVYDPCTVITIGVFDNCHLNGGEKANGARDTRIGKVR

SEQ ID NO: 544 - protein, 94 aa, Artificial Sequence
  Synthetically generated peptide
LEVGILSAQGLSPMKTKDGKATTDPYCVAKYGQKWVRTRTIIDSSSPKWNEQYTWEVYDPCTVITLGVFDNCHLGGSEKSNSGAKVDSRIGKVR

SEQ ID NO: 545 - protein, 94 aa, Artificial Sequence; identical to SEQ ID NO: 544
  Synthetically generated peptide

SEQ ID NO: 546 - protein, 88 aa, Artificial Sequence
  Synthetically generated peptide
LEVGIISAHGLMPMKSKDGKGTTDAYCVAKYGQKWIRTRTIVDSFTPKWNEQYTWEVFDTCTVITFGAFDNGHIPGGSGKDLRIGKVR

SEQ ID NO: 547 - protein, 93 aa, Artificial Sequence
  Synthetically generated peptide
LEMGILGAKGLLPMKMKDGHGSTDAYCVAKYGQKWIRTRTLLDTFSPKWNEQYTWEVYDPCTVITLGVFDNCHLGEKAPSGSSIKDSRIGKVR

SEQ ID NO: 548 - protein, 98 aa, Artificial Sequence
  Synthetically generated peptide
LEVGILGAQKLLPMKMNNSRGSTDAYCVAKYGQKWIRTRTILDTFSPKWNEQYTWEVYDPCTVITLGVFDNCHLGGGGEKAPSGGSNAARDSRIGKVR

SEQ ID NO: 549 - protein, 93 aa, Artificial Sequence
  Synthetically generated peptide
LEIGILGANGLVPMKLKDGRGSTNAYCVAKYGQKWVRTRTILDTLSPRWNEQYTWEVYDPCTVITLGVFDNSHLGSAQSGTADSRDARIGKVR

SEQ ID NO: 550 - protein, 103 aa, Artificial Sequence
  Synthetically generated peptide
LEVGILGAAGLQPMKNRDGRGTTDAYCVAKYGQKWVRTRTMLGTFSPTWNEQYTWEVFDPCTVITIGVFDNNHLGNGNGNGNNAGGGGGGSPPARDARVGKIR

SEQ ID NO: 551 - protein, 86 aa, Artificial Sequence
  Synthetically generated peptide
LEMGILGAHGLPPMKSKDGWTTTDAYCVAKFGTKWVRTRTITNNFHPKWNEQYTWEVFDPCSIITIGVFDNNFHLQGGDKRIGKVR

SEQ ID NO: 552 - protein, 92 aa, Artificial Sequence
  Synthetically generated peptide
LEVGVLGAQGLPPMKTAADGGRGTTDAYCVAKYGHKWVRTRTVVDSSTPRWNEQYTWEVYDPCTVLTLAVFDNCNLGNGGGGGKDQRIGKVR

SEQ ID NO: 553 - protein, 96 aa, Artificial Sequence
  Synthetically generated peptide
LELGVLGATGLIPMKARDGRGATSDAYCVAKYGQKWIRTRTVVDSVCPRWNEQYTWEVFDPCTVITVGVFDNCHVDKPASGNTTLAVRDNCIGKVR

SEQ ID NO: 554 - protein, 88 aa, Artificial Sequence
  Synthetically generated peptide
LELGILSARNLMPMKGKDGRMTDPYCVAKYGNKWVRTRTLLDALAPKWNEQYTWEVHDPCTVITIGVFDNSHVNDGGDFKDQRIGKVR

SEQ ID NO: 555 - protein, 88 aa, Artificial Sequence; identical to SEQ ID NO: 554
  Synthetically generated peptide

SEQ ID NO: 556 - protein, 88 aa, Artificial Sequence
  Synthetically generated peptide
LELGILGARNLIPMKGKDGRTTDAYCVAKYGPKWVRTRTILNTLNPQWNEQYTWEVFDPCTVITVVVFDNNQIGKNGDARDESIGKVR

SEQ ID NO: 557 - protein, 81 aa, Artificial Sequence
  Synthetically generated peptide
LELGILGARNLAGGKSPYCVAKYGAKWVRTRTLVGTAAPRWNEQYTWEVFDLCTVVTVAVFDNCHLTGGGDAKDQRIGKVR

SEQ ID NO: 558 - protein, 73 aa, Artificial Sequence
  Synthetically generated peptide
RKGTSDTYVVAKYGHKWVRSRTVINSMNPKYNEQYTWEVFDPATVLTICVFDNAHFAAGDGGNKRDQPIGKVR

SEQ ID NO: 559 - protein, 91 aa, Artificial Sequence
  Synthetically generated peptide
LELGILNANVFHSMKTREGKGTSDTYVVAKYGHKWVRSRTVINSMNPKYNEQYTWEVFDPATVLTICVFDNAHFAAGDGGNKRDQPIGKVR

SEQ ID NO: 560 - protein, 89 aa, Artificial Sequence
  Synthetically generated peptide
LELGILRIEGLNLSQEGKKETVDAYCVAKYGTKWVRTRTVTNCLNPRFNEQYTWEVYEPATVITIGVFDNNQINSGNGNKGDGKIGKIR

SEQ ID NO: 561 - protein, 95 aa, Artificial Sequence
  Synthetically generated peptide
LEVGILSANGLNPTKTKHERGSCDAYCVAKYGQKWVRTRTIVDNLNPRFNEQYTWDVFDHGTVLTIGLFDNCHISADSNHSSSPGHMDKPIGKVR

SEQ ID NO: 562 - protein, 79 aa, Artificial Sequence
  Synthetically generated peptide
RDGRGSCDAYCVAKYGVKWYRTRTVTDSISPRFHQQYHWEVHDHCTVLTVAVFHNSQIGDKGGLVAGDPVKDVLLGKVR

SEQ ID NO: 563 - protein, 94 aa, Artificial Sequence
  Synthetically generated peptide
VELGIIGCKNLLPMKTVNGKGSTDAYTVAKYGSKWVRTRTVSDSLDPKWNEQYTWKVYDPCTVLTIGVFDSWGVYEVDGGKEATRQDLRIGKVR

SEQ ID NO: 564 - protein, 98 aa, Artificial Sequence
  Synthetically generated peptide
VELGIVGCKGLLPMRTADGKGCTDAYAVAKYGPKWARTRTISDSFDPAWNEQYTWPVYDPCTVLTVGVFDDPPPPSPSQLPDGAKDAAAFSRPMGKVR

SEQ ID NO: 565 - protein, 92 aa, Artificial Sequence
  Synthetically generated peptide
LELGILGARGLLPMKAKNGGKGSTDAYCVAKYGKKWVRTRTITDSFDPRWHEQYTWQVYDPCTVLTVGVFDNWRMFSDASDDRPDTRIGKIR

SEQ ID NO: 566 - protein, 92 aa, Artificial Sequence; identical to SEQ ID NO: 565
  Synthetically generated peptide

SEQ ID NO: 567 - protein, 95 aa, Artificial Sequence
  Synthetically generated peptide
LELGIIGACGLLPMKTKGGAKGSTDAYCVAKYGKKWVRTRTVTDSLNPRWNEQYTWQVYDPCTVLTVAVFDNWRMFAFAGAGDEQRQDYRIGKVR

SEQ ID NO: 568 - protein, 98 aa, Artificial Sequence
  Synthetically generated peptide
LEVGIRGAANLVPMKIAKDGASGSTDAYVVLKYGPKWARTRTILDQFNPRWNEQYAWDVFDPCTVLTIAVFDNVRYRSAEASGDAGKLPKDARIGKLR

SEQ ID NO: 569 - protein, 93 aa, Artificial Sequence
  Synthetically generated peptide
LEVGIRGATNLLPVKTRDGTRGTTDAYVVAKYGPKWIRTRTILDRFNPRWNEQYTWDVYDPCTVLTIGVFDNGRYKRDESGKQGRDVRVGKIR

SEQ ID NO: 570 - protein, 87 aa, Artificial Sequence
  Synthetically generated peptide
LEIGILGATGLKGSDERKQGIDSYVVAKYGNKWARTRTVVNSVTPKWNEQYSWDDYEKCTVLTLGIYDNRQIFKEDQANDVPIGKVR

SEQ ID NO: 571 - protein, 88 aa, Artificial Sequence
  Synthetically generated peptide
LEIGILGATGLKGSDEKKQTIDSYVVAKYGNKWARTRTVVNSVSPKWNEQYSWDVYEKCTVLTLGIYDNRQILEDKNKANDVPIGKVR

SEQ ID NO: 572 - protein, 83 aa, Artificial Sequence
  Synthetically generated peptide
VHLGILRATGLPLRMGKSTVNPYCVAKYGDKWVRTRTILDGPEHVFNEQHTWSVYDIATVLTAGVFDHFPHTRKAHREIGKVQ

SEQ ID NO: 573 - protein, 83 aa, Artificial Sequence
  Synthetically generated peptide
LSVTVISGEDLPAMDMNGKSDPYVVLSLKKSKTKYKTRVVSESLNPVWNQTFDFVVEDGLHDMLMLEVYDHDTFSRDYMGRCI

SEQ ID NO: 574 - protein, 83 aa, Artificial Sequence; identical to SEQ ID NO: 573
  Synthetically generated peptide

SEQ ID NO: 575 - protein, 46 aa, Artificial Sequence
  Synthetically generated peptide
RVVNESLNPVWNQTFDFVVEDGLHDMLVLEVYDHDTFSRDYMGRCI

SEQ ID NO: 576 - protein, 83 aa, Artificial Sequence
  Synthetically generated peptide
LSVTVISAEEIPIQDLMGKADPYVVLSMKKSGAKSKTRVVNDSLNPVWNQTFDFVVEDGLHDMLVLEVWDHDTFGKDYIGRCI

SEQ ID NO: 577 - protein, 83 aa, Artificial Sequence; identical to SEQ ID NO: 576
  Synthetically generated peptide

SEQ ID NO: 578 - protein, 83 aa, Artificial Sequence
  Synthetically generated peptide
LSVTVISAEDLPIVDFMGKADPFVVLALKKSEKKQKTRVVNETLNPVWNQTFDFVVEDGLHDMLIVELWDHDTFGKEKMGKVI

SEQ ID NO: 579 - protein, 83 aa, Artificial Sequence
  Synthetically generated peptide
LSVTVISAEDLPAVDFMGKSDPFVVLTLKKAETKNKTRVVNNSLNPVWNQTFDFVVEDGLHDMLLVEVYDHDTFGKDYMGRVI

SEQ ID NO: 580 - protein, 83 aa, Artificial Sequence
  Synthetically generated peptide
LSVTVISAEDLPPMDVMGKADPFVVLYLKKGETKKKTRVVTETLNPIWNQTFDFVVEDALHDLLMVEVWDHDTFGKDYIGRCI

SEQ ID NO: 581 - protein, 83 aa, Artificial Sequence; identical to SEQ ID NO: 580
  Synthetically generated peptide

SEQ ID NO: 582 - protein, 83 aa, Artificial Sequence
  Synthetically generated peptide
LSVTVVAAEDLPAVDFMGKADAFVVITLKKSETKSKTRVVPDSLNPVWNQTFDFVVEDALHDLLTLEVWDHDKFGKDKIGRVI

SEQ ID NO: 583 - protein, 82 aa, Artificial Sequence
  Synthetically generated peptide
LIVTVVKATNLKNKELIGKSDPYATIYIRPVFKYKTNAIDNNLNPVWDQTFELIAEDKETQSLTVEVFDKDVGQDERLGLVK

SEQ ID NO: 584 - protein, 82 aa, Artificial Sequence
  Synthetically generated peptide
LIVTVVKATNLKNKELIGKSDPYATIYIRPVFKYKTKAIENNLNPVWDQTFELIAEDKETQSLTVEVFDKDVGQDERLGLVK

SEQ ID NO: 585 - protein, 44 aa, Artificial Sequence
  Synthetically generated peptide
IENNLNPVWDQTFELIVEDKETQSLTVEVFDKDVGQDERLGLVK

SEQ ID NO: 586 - protein, 79 aa, Artificial Sequence
  Synthetically generated peptide
TVVKATNLKNKEFIGKSDPYATIHIRPVFKYNTKAIENNLNPVWDQTFDLIAEDKETQSLTIEVFDKDVGQDERLGLVK

SEQ ID NO: 587 - protein, 83 aa, Artificial Sequence
  Synthetically generated peptide
LTVTIVKANGLKNHEMIGKSDPYAVVHIRPLFKVKTKTIDNNLNPVWDQTFELIAEDKETQSLFIEVFDKDNIGQDQRMGVAK

SEQ ID NO: 588 - protein, 83 aa, Artificial Sequence
  Synthetically generated peptide
LTVTVVKATSLKNKELIGKSDPYVILYVRPMFKVKTKVIDDNLNPEWNETFPLIVEDKETQSVIFEVYDEDRLQQDKKLGVAK

SEQ ID NO: 589 - protein, 85 aa, Artificial Sequence
  Synthetically generated peptide
LEVKLVEARDLTNKDLVGKSDPFAVLYIRPLQDKMKKSKTINNDLNPIWNEHYEFVVEDTSTQRLTVKIYDDEGLQASELIGCAR

SEQ ID NO: 590 - protein, 85 aa, Artificial Sequence; identical to SEQ ID NO: 589
  Synthetically generated peptide

SEQ ID NO: 591 - protein, 85 aa, Artificial Sequence
  Synthetically generated peptide
LEVKLVQAKNLTNKDLVGKSDPFAKMFIRPLREKTKRSKTINNDLNPIWNEHFEFVVEDASTQHLVVRIYDDEGVQASELIGCAQ

SEQ ID NO: 592 - protein, 85 aa, Artificial Sequence; identical to SEQ ID NO: 591
  Synthetically generated peptide

SEQ ID NO: 593 - protein, 85 aa, Artificial Sequence
  Synthetically generated peptide
LEVKLVQARDLTNKDLIGKSDPFAIVYVRPLPDKMKRSKTINNDLNPIWNEHFEFIVEDADTQTVTVKIYDDDGIQESELIGCAQ

SEQ ID NO: 594 - protein, 85 aa, Artificial Sequence; identical to SEQ ID NO: 593
  Synthetically generated peptide

SEQ ID NO: 595 - protein, 85 aa, Artificial Sequence
  Synthetically generated peptide
LEVKLVQAKELTNKDIIGKSDPYAVLYIRPLRNRTKKSKTINNDLNPIWNEHFEFIVEDASTQHLFVKVYDDEGLQSSELIGCTD

SEQ ID NO: 596 - protein, 85 aa, Artificial Sequence
  Synthetically generated peptide
LDVKLVQAKNLSNKDIIGKSDPFAVVFVRPLRDKTKTSKIINNQLNPIWNEHFEFIIEDESTQHLTIRIFDDEGIQAAELIGCAQ

SEQ ID NO: 597 - protein, 85 aa, Artificial Sequence
  Synthetically generated peptide
LDVKVVQAKDLANKDMIGKSDPYAIVFIRPLPDRTKKTKTISNSLNPIWNEHFEFIVEDVSTQHLTVRVFDDEGVGSSQLIGAAQ

SEQ ID NO: 598 - protein, 82 aa, Artificial Sequence
  Synthetically generated peptide
KVVRAVGLRKKDMMGGADPYVKIKLSEDKIPSKKTTVKHKNLNPEWNEEHKFSVRDPQTQVLEFSVYDWGQLGKHDKMGMNV

SEQ ID NO: 599 - protein, 85 aa, Artificial Sequence
  Synthetically generated peptide
VHVKVVRAVGLRKKDLMGGADPFVKIKLSEDKIPSKKTTVKHKNLNPEWNEEFKFSVRDPQTQVLEFSVYDWEQVGNPEKMGMNV

SEQ ID NO: 600 - protein, 68 aa, Artificial Sequence
  Synthetically generated peptide
GMINPYVQIELSEDKISSKKTTVKHKNLNPEWNEEFKFSVRDPKTQVLEFNVYDWEKIGKHDKMGMNV

SEQ ID NO: 601 - protein, 85 aa, Artificial Sequence
  Synthetically generated peptide
LHVKVLHAMKLKKKDLLGASDPYVKLKLTDDKMPSKKTTVKHKNLNPEWNEEFNLVVKDPETQVLQLNVYDWEQVGKHDKMGMNV

SEQ ID NO: 602 - protein, 85 aa, Artificial Sequence
  Synthetically generated peptide
LSVKVIKAIKLKKKDLLGGSDPYVKLTLSGDKVPGKKTVVKHSNLNPEWNEEFDLVVKEPESQELQLIVYDWEQVGKHDKIGMNV

SEQ ID NO: 603 - protein, 85 aa, Artificial Sequence
  Synthetically generated peptide
LHVNIVRAVKLTKKDFLGKSDPYVKLKLTEEKLPSKKTSVKRSNLNPEWNEDFKLVVKDPESQALELTVYDWEQVGKHDKIGMSV

SEQ ID NO: 604 - protein, 85 aa, Artificial Sequence
  Synthetically generated peptide
LHVSILRARNLLKKDLLGTSDPYVKLSLTGEKLPAKKTTIKKRNLNPEWNEHFKLIVKDPNSQVLQLEVFDWDKVGGHDRLGMQM

SEQ ID NO: 605 - protein, 85 aa, Artificial Sequence; identical to SEQ ID NO: 604
  Synthetically generated peptide

SEQ ID NO: 606 - protein, 85 aa, Artificial Sequence; identical to SEQ ID NO: 604
  Synthetically generated peptide

SEQ ID NO: 607 - protein, 85 aa, Artificial Sequence
  Synthetically generated peptide
LHVKVIRAMNLLKMDLLGKSDPYVKLRLSGEKLPSKKTSIKMSNLNPEWNEHFRFIVKDPETQILELRMFDWEKVKMHDKLGMQV

SEQ ID NO: 608 - protein, 79 aa, Artificial Sequence
  Synthetically generated peptide
LLVKVLRAQNLREKGPLGKRDPYVKLKMSGSKLPSKKTAVKHSNLNPEWNQEFKFVIRDPETQELDINFGKDEKLGMCK

SEQ ID NO: 609 - protein, 85 aa, Artificial Sequence
  Synthetically generated peptide
LLVKVLRAQNLRKKDLLGKSDPYVKLKMSDDKLPSKKTTVKRSNLNPEWNEDFKFVVTDPETQALEINVFDWEQVGKHEKMGMNN

SEQ ID NO: 610 - protein, 86 aa, Artificial Sequence
  Synthetically generated peptide
LSVTLVDAQKLRYMFFGKTDPYAILRLGDQVIRSKRNSQTTVIGAPGQPIWNQDFQFLVSNPREQVLQIEVNDRLGFADMAIGTGE

SEQ ID NO: 611 - protein, 86 aa, Artificial Sequence; identical to SEQ ID NO: 610
  Synthetically generated peptide

SEQ ID NO: 612 - protein, 86 aa, Artificial Sequence
  Synthetically generated peptide
LSVTLVNAQKLPYMFSGRTDPYVILRIGDQVIRSKKNSQTTVIGAPGQPIWNQDFQFLVSNPREQVLQIEVNDCLGFADMAIGIGE

SEQ ID NO: 613 - protein, 42 aa, Artificial Sequence
  Synthetically generated peptide
LSVTLVDARKLPYFFGKTDPYVILSLGDQTIRSKKNSQTTVI

SEQ ID NO: 614 - protein, 86 aa, Artificial Sequence
  Synthetically generated peptide
LSVTLVDARKLSFVLFGKTDPYVVMILGDQEIKSKKNSQTTVIGQPGEPIWNQDFHMLVANPRKQKLCIQVKDSVGLTDVTIGTGE

SEQ ID NO: 615 - protein, 84 aa, Artificial Sequence
  Synthetically generated peptide
FRCVNLDNKDLFSKSDPFLRISRVVETSAAVPICRTEVVDNNLNPMWRPVCLTMQQFGSKDTPLVIECLDFNTSGNHELIGKTE

SEQ ID NO: 616 - protein, 84 aa, Artificial Sequence; identical to SEQ ID NO: 615
  Synthetically generated peptide

SEQ ID NO: 617 - protein, 84 aa, Artificial Sequence
  Synthetically generated peptide
FRCVNLDNKDLFSKSDPFLRISRVVETSAAVPICRTEVVDNNLNPMWRPVCLTMQQFGSKDTPLVIECLDFNTSGNHELMKDRE

SEQ ID NO: 618 - protein, 85 aa, Artificial Sequence
  Synthetically generated peptide
VFRGLNLESKDTFSKSDPFLVISKIVEHGTPIPVSKTEVLKNDPNPLWKPVSLSVQQVGSKDSPLVIECLDFNGNGNHDLIGKVQ

SEQ ID NO: 619 - protein, 85 aa, Artificial Sequence; identical to SEQ ID NO: 618
  Synthetically generated peptide

SEQ ID NO: 620 - protein, 85 aa, Artificial Sequence; identical to SEQ ID NO: 618
  Synthetically generated peptide

SEQ ID NO: 621 - protein, 85 aa, Artificial Sequence
  Synthetically generated peptide
VFRCSNLESKDLFSKSDPFLVVSKIVEHGTPIPVSKTEVRKNDLNPIWKPVFLSVQQVGSKDSPVIIECSDFNSNGKHSLIGKVQ

SEQ ID NO: 622 - protein, 85 aa, Artificial Sequence; identical to SEQ ID NO: 621
  Synthetically generated peptide

SEQ ID NO: 623 - protein, 89 aa, Artificial Sequence
  Synthetically generated peptide
IMEMVFRCSDLEIKDLLSKSDPFLLISRISESGVPVPICKTEVRKNDLNPKWKPVILNLQQIGSKENPLIIECFNFSSNGKHDLIGKIV

SEQ ID NO: 624 - protein, 94 aa, Artificial Sequence
  Synthetically generated peptide
FSASNLRDRDVISKSDAMVVVYTKGRDGTLAELFRSEVVLNSLNPKWIKNFTIGYQFEIVQTLLFRVYDIDTQFQNSKEELLKLDEQQFLGEAT

SEQ ID NO: 625 - protein, 94 aa, Artificial Sequence; identical to SEQ ID NO: 624
  Synthetically generated peptide

SEQ ID NO: 626 - protein, 94 aa, Artificial Sequence; identical to SEQ ID NO: 624
  Synthetically generated peptide

SEQ ID NO: 627 - protein, 94 aa, Artificial Sequence
  Synthetically generated peptide
FSASNLRDRDVLSKSDPMVVVYQKEKDATLSEVFRSEVVLNSLAPKWIKKFIVAYHFETVQTLVFRVYDVDTKFQNSREEMLKLDEQQFLGEAT

SEQ ID NO: 628 - protein, 94 aa, Artificial Sequence; identical to SEQ ID NO: 627
  Synthetically generated peptide

SEQ ID NO: 629 - protein, 94 aa, Artificial Sequence
  Synthetically generated peptide
LSASNLGDQEFFTKSNPMVIVYSKSKEGALEELGRTEVILNSLNPSWNARINVHYQFEVLQPIVFQVYDIDPQFHDVNEKMLKLEEQQFLGEAV

SEQ ID NO: 630 - protein, 94 aa, Artificial Sequence
  Synthetically generated peptide
LSASNLLDCDITSKSDPMAVMYLRKKDGRLEEIGRTEVILNNLNPKWIEKITVSFQFEAVQTLVFHVYDVDTRYHNVPVKTLKLKDQDFLGEGT

SEQ ID NO: 631 - protein, 94 aa, Artificial Sequence; identical to SEQ ID NO: 630
  Synthetically generated peptide

SEQ ID NO: 632 - protein, 88 aa, Artificial Sequence
  Synthetically generated peptide
VNQLTLSASNLLDCDITSKSDPMAVMYLRKKDGRLEEIGRTEVILNNLNPKWIEKITVSFQFEAVQTLVFHVYDVDTRYHNVPVKVIF

SEQ ID NO: 633 - protein, 93 aa, Artificial Sequence
  Synthetically generated peptide
FSASKLRNMDAFSKSDPMLVIYIRKDARLEEIGRTEVILNSLEPSWITKATISYQFEIIQPLVFKIYDIDTRYHNTPVKTLNLAQQDFLGEAC

SEQ ID NO: 634 - protein, 82 aa, Artificial Sequence
  Synthetically generated peptide
MTVALIEGTGITNSNSKELFDMYAVFTCNAKRKTSSVKFQTSEPKWNEIYEFDAMDDPPSRMDVAIHDANGPFDQSPIGHAE

SEQ ID NO: 635 - protein, 82 aa, Artificial Sequence
  Synthetically generated peptide
LTVALIEGSGVVGSGTPGLPDPYVVFTCNGKRKTSSVKFQTSEPKWNEIFEFNAMDDPPSRLEVVVHDSEGPHNKIPIGQTE

SEQ ID NO: 636 - protein, 83 aa, Artificial Sequence
  Synthetically generated peptide
LTVALIEGTKLAPVDATGFSDPYVVFTCNGKSKTSSIKFQTLEPQWNDIFEFDAMDDPPSVMNVHVYDFDGPFDEVTSLGHAE

SEQ ID NO: 637 - protein, 83 aa, Artificial Sequence
  Synthetically generated peptide
LTVALIDGTNLAATKSSGYSDPYVVFTCNGKTKTSSIKFHTLEPRWNEIFEFDAMEDPPSVMKINVYDFDGPFDEVESLGHAE

SEQ ID NO: 638 - protein, 83 aa, Artificial Sequence
  Synthetically generated peptide
LTVALIEGVDLAAVDPSGHCDPYIVFTSNGKTRTSSIKFQKSNPQWNEIFEFDAMADPPSVLNVEVFDFDGPFDEAVSLGHAE

SEQ ID NO: 639 - protein, 83 aa, Artificial Sequence
  Synthetically generated peptide
LTIALIKGTNLASVEATELFDPYVVFTCNGKTRTSSVKLQAQDPQWNEVIEFDAMEEPPSVLDVEVFDFDGPFDQGASLGHAE

SEQ ID NO: 640 - protein, 82 aa, Artificial Sequence
  Synthetically generated peptide
LTVALLEATSLPPVSSGSVDPYVVFSCNGITRTSSVQLQTHDPQWNEIMEFDAMEEPPATLDVEVFNFDGPFDLAVSLGHAE

SEQ ID NO: 641 - protein, 44 aa, Artificial Sequence
  Synthetically generated peptide
RRTKEPTWNEEFTFNISLSRENLLQVAAWDANLVTPHKRMGNAG

SEQ ID NO: 642 - protein, 65 aa, Artificial Sequence
  Synthetically generated peptide
GTSDPYVVMDLDGQVAKSKTKWGTKEPKWNEDFVFNIKLPPAKKIEIAAWDANLVTPHKRMGNSE

SEQ ID NO: 643 - protein, 94 aa, Artificial Sequence
  Synthetically generated peptide
LKVKIYTGEGWDLDFHHTHFDQYSPPDFFVKIGIAGVPRDTVSYRTETAVDQWFPIWGNDEFLFQLSVPELALLWFKVQDYDNDTQNDFAGQTC

SEQ ID NO: 644 - protein, 94 aa, Artificial Sequence; identical to SEQ ID NO: 643
  Synthetically generated peptide

SEQ ID NO: 645 - protein, 94 aa, Artificial Sequence; identical to SEQ ID NO: 643
  Synthetically generated peptide

SEQ ID NO: 646 - protein, 94 aa, Artificial Sequence; identical to SEQ ID NO: 643
  Synthetically generated peptide

SEQ ID NO: 647 - protein, 93 aa, Artificial Sequence
  Synthetically generated peptide
LKVKIYTGEGWNMDFPLDHFDRYSPPDFYAKVGIAGVPLDTASYRTEIDKDEWFPIWDKEFEFPLRVPELSLLCITVKDYDSNTQNDFAGQTC

SEQ ID NO: 648 - protein, 93 aa, Artificial Sequence; identical to SEQ ID NO: 647
  Synthetically generated peptide

SEQ ID NO: 649 - protein, 93 aa, Artificial Sequence
  Synthetically generated peptide
LKVKVCMGDGWLLDFKKTHFDSYSPPDFFVRVGIAGAPVDEVMEKTKIEYDTWTPIWNKEFTFPLAVPELALLRVEVHEHDVNEKDDFGGQTC

SEQ ID NO: 650 - protein, 93 aa, Artificial Sequence; identical to SEQ ID NO: 649
  Synthetically generated peptide

SEQ ID NO: 651 - protein, 93 aa, Artificial Sequence; identical to SEQ ID NO: 649
  Synthetically generated peptide

SEQ ID NO: 652 - protein, 93 aa, Artificial Sequence
  Synthetically generated peptide
LKVTVYMGDGWRFDFRKTHFDKCSPPDFYARVGIAGVEADTRMEQTKVKMDTWIPAWDHEFEFPLSVPELALLRVEVHESDNHQKDDFGGQTC

SEQ ID NO: 653 - protein, 93 aa, Artificial Sequence
  Synthetically generated peptide
LRVTVYMGEGWYFDFRHTHFDQYSPPDFYTRVGIAGVPGDTVMKKTKTLEDNWIPAWDEVFEFPLTVPELALLRLEVHEYDMSEKDDFGGQTC

SEQ ID NO: 654 - protein, 93 aa, Artificial Sequence; identical to SEQ ID NO: 653
  Synthetically generated peptide

SEQ ID NO: 655 - protein, 93 aa, Artificial Sequence; identical to SEQ ID NO: 653
  Synthetically generated peptide

SEQ ID NO: 656 - protein, 93 aa, Artificial Sequence
  Synthetically generated peptide
LRVTIYMGEGWYFDFRHTHFDQYSPPDFYTRVGIAGVPADTVMKKTKTLEDNWVPSWDEVFEFPLTVPELALLRLEVHEYDMSEKDDFGGQTC

SEQ ID NO: 657 - protein, 93 aa, Artificial Sequence
  Synthetically generated peptide
LRVTIYMGEGWYYDFPHTHFDRYSPPDFYTRVGIAGVPADTVMKKTKTLEDNWIPAWDEVFEFPLTVPELALLRIEVHEYDMSEKDDFGGQIC

SEQ ID NO: 658 - protein, 93 aa, Artificial Sequence
  Synthetically generated peptide
LKVTVYMGEGWYYDFKHTHFDQYSPPDFYTRVGIAGVPNDTIMKRTKAIEDNWLPTWNEAFEFPLTVPELALLRIEVHEYDMSEKDDFGGQTC

SEQ ID NO: 659 - protein, 93 aa, Artificial Sequence
  Synthetically generated peptide
LKVTVYMGEGWYYDFKHTHFDQYSPPDFYTRVGIAGVPNDTIMKRTKAIEDNWLPTWNEVFEFPLTVPELALLRIEVHEYDMSEKDDFGGQAC

SEQ ID NO: 660 - protein, 93 aa, Artificial Sequence
  Synthetically generated peptide
LKVTVYMGEGWYYDFKHTHFDQYSPPDFYTRVGIAGVPSDTVMKKTKANKDNWLPTWNETFEFPLSVPELALLRIEVHEYDMSEKDDFGGQTC

SEQ ID NO: 661 - protein, 93 aa, Artificial Sequence
  Synthetically generated peptide
LKVTVYMGEGWYYDFKHTHFDQFSPPDFYARIGIAGVPFDTVMKKTKSIEDSWLPSWNEVFEFPLSVPELALLRIEVHEYDMSEKDDFGGQTC

SEQ ID NO: 662 - protein, 93 aa, Artificial Sequence
  Synthetically generated peptide
LKVTVYMGEGWYYDFKHTHFDQFSPPDFYARVGIAGVPFDTVMKKTKSIEDSWLPSWNEVFEFPLSVPELALLRIEVHEYDMSEKDDFGGQTC

SEQ ID NO: 663 - protein, 93 aa, Artificial Sequence
  Synthetically generated peptide
LKVTVYMGEGWYYDFKHTHFDQFSPPDFYARVGIAGVPFDTIMKKTKTVEDSWLPSWNEVFEFPLSVPELALLRIEVHEYDMSEKDDFGGQTC

SEQ ID NO: 664 - protein, 93 aa, Artificial Sequence
  Synthetically generated peptide
LKVTVYMGEGWYYDFDHTHFDQFSPPDFYARVGIAGVPFDTIMKKTKTVEDSWLPSWNEVFEFPLSVPELALLRIEVHEYDMSEKDDFGGQTC

SEQ ID NO: 665 - protein, 93 aa, Artificial Sequence
  Synthetically generated peptide
LKVTIYMGEGWFLDFKHTHFDKFSPPDFYARVGIAGVPNDTVMKKTEKVEDNWSPSWNQVFKFPLAVPELALLRVEVHEYDMSEKDDFGGQTC

SEQ ID NO: 666 - protein, 93 aa, Artificial Sequence
  Synthetically generated peptide
LKVTIYMGEGWFHDFKHTHFDQYSPPDFYARVGIAGVPYDTVMKKTKSVEDNWSPSWNEEFKFPLSVPELALLRVEVHEYDMSEKDDFGGQTC

SEQ ID NO: 667 - protein, 93 aa, Artificial Sequence
  Synthetically generated peptide
LKVTVFMGEGWYIDFKHTHFDAYTPPDFYAKIGIAGVPADNVMKKTKTLEDMDTPTWDEKFEFPLTVPELALLRVEVHEYDMSEKDDFAGQTC

SEQ ID NO: 668 - protein, 93 aa, Artificial Sequence
  Synthetically generated peptide
LKVTVFMGEGWYYDFNHTHFDAYAPPDFYAKIGIAGVPADNVMKKTRTLENNWIPTWDEKFEFPLTVPELALLRVEVHVYDMSEKDDFAGQTC

SEQ ID NO: 669 - protein, 93 aa, Artificial Sequence
  Synthetically generated peptide
LKVTVFMGEGWYYDFEHTHFDAYSPPDFYARIGIAGVDADIVMKKTKTLEDNWIPTWDEQFEFPLTVPELALLRVEVHEYDMSEKDDFAGQTC

SEQ ID NO: 670 - protein, 93 aa, Artificial Sequence
  Synthetically generated peptide
LKVKVYMGKGWHLDFKRTHFDAYSPPDFYVKIGIAGVAADSRVKKTKAIEDNWIPIWNDEFEFPLTVPELALLRVEVHEYDMSEIDDFGGQTC

SEQ ID NO: 671 - protein, 93 aa, Artificial Sequence
  Synthetically generated peptide
LKVKVYMGDGWRMDFSKTHFDTFSPPDFYTRVGIAGVRADCVMKKTRTIEDQWVPMWDEEFTFPLTVPELAVLRIEVHEYDMSEKHDFGGQTC

SEQ ID NO: 672 - protein, 93 aa, Artificial Sequence; identical to SEQ ID NO: 671
  Synthetically generated peptide

SEQ ID NO: 673 - protein, 93 aa, Artificial Sequence
  Synthetically generated peptide
LKVKVYMGDRWRMDFSKTHFDAFSPPDFYTKVGIAGVKADSVMKKTRVIEDQWVPMWDEEFTFLLTVPELALLRVEVQEYDMSEKHDFGGQTV

SEQ ID NO: 674 - protein, 93 aa, Artificial Sequence
  Synthetically generated peptide
LKVKVYMGDGWRMDFTQTHFDQYSPPDFYARVGIAGVPADSVMKRTRAIEDNWVPVWEEDFTFKLTVPEIALLRVEVHEYDMSEKDDFGGQTV

SEQ ID NO: 675 - protein, 93 aa, Artificial Sequence; identical to SEQ ID NO: 674
  Synthetically generated peptide

SEQ ID NO: 676 - protein, 93 aa, Artificial Sequence
  Synthetically generated peptide
LKVKVYMGDGWRMDFKSTHFDTYSPPDFYTRVGIAGVPADCTMKKTRTIEDDWTPVWDEELVFPLTVPELALLRIEVHEYDMSDKDDFGGQTC

SEQ ID NO: 677 - protein, 93 aa, Artificial Sequence
  Synthetically generated peptide
  misc_feature (41)..(41): Xaa can be any naturally occurring amino acid
LKVKVYMGDGWRMDFKQTYFDAYSPPDFYTRIGIAGVPADXVMKRTKAIEDDWTPVWNEEFVFPLTVPEIALLRIEVHEYDMSEKDDFGGQTC

SEQ ID NO: 678 - protein, 93 aa, Artificial Sequence
  Synthetically generated peptide
LKVKVYMGDGWHLDFKQTHFDLYSPPDFYTRVGIAGVPADEIMKKTKTKEDKWTPVWDEAFTFPLTVPELALLRIEVHEYDMSEKDDFAGQTC

SEQ ID NO: 679 - protein, 93 aa, Artificial Sequence
  Synthetically generated peptide
LKVKVYMGDGWHLDFKQTHFDLYSPPDFYTRVGIAGVPADEIMKKTKTKEDKWTPVWDEEFTFPLTVPELALLRIEVHEYDMSEKDDFAGQTC

SEQ ID NO: 680 - protein, 91 aa, Artificial Sequence
  Synthetically generated peptide
LQVRVYMGDGWRLDFSHTHFDAYSPPDFYTKVIGVPADSRKKKTRILEDDWCPVWDEEFNFPLTVPELALLRIEVREYDMSEKDDFGGQTC

SEQ ID NO: 681 - protein, 93 aa, Artificial Sequence
  Synthetically generated peptide
LKVKVYMGDGWRMDFSHTHFDAYSPPDFYTKMFIVGVPADNAKKKTKIIEDNWYPIWDEEFSFPLTVPELALLRIEVREYDMSEKDDFGGQTC

SEQ ID NO: 682 - protein, 92 aa, Artificial Sequence
  Synthetically generated peptide
LKVKVYMGEGWHKDFKQTHFDTYSPPDFYVEVGIAGVPLDSVMRKTKAVEDNWVPVWEEEFAFPLTVPEIAVLRVEVHEQDVSEDDFGGQTA

SEQ ID NO: 683 - protein, 93 aa, Artificial Sequence
  Synthetically generated peptide
LKVTVYMGDGWDKDFDQTHFDTYSPPDFYAKLGIAGVPADEVKKRTKTMDDNWIPSWDEQFEFPLTVPELALLRIKVLDYNLSDKDEFAGQTC

SEQ ID NO: 684 - protein, 93 aa, Artificial Sequence
  Synthetically generated peptide
LKVTVYMGDGWDKDFDQTDFDTYSPPDFYAKLGIAGVPADEVKKRTETIDDNWIPSWNEQFEFPLTVPELALLRIKVLDYNLSDKDEFAGQTC

SEQ ID NO: 685 - protein, 93 aa, Artificial Sequence
  Synthetically generated peptide
LKVKVYLGKGWSLDFSPSDFDSYSPPDFYVKVCIVGVPADMIKKKTSVISNNWFPVWNEEFDFPLTVPELALLGIEVREDDKHQKDDFGGQTC

SEQ ID NO: 686 - protein, 93 aa, Artificial Sequence
  Synthetically generated peptide
LKVKVYLGKGWSLDFSPSDFDSYSPPDFYVKVCIVGVPADMIKKKTSVISNNWFPVWNEEFDFPLTVPELALLRIEVREEDKHQKDDFGGQTC

SEQ ID NO: 687 - protein, 93 aa, Artificial Sequence
  Synthetically generated peptide
LKVKVYMGNGWSSDFSKTHFDSFSPPDFYTKVCIVGVPADKANKKTKVIQDNWFPVWDEEFEFPLTVPELALLRIEVREYDKHEKDDFGGQTC

SEQ ID NO: 688 - protein, 92 aa, Artificial Sequence
  Synthetically generated peptide
LKVKVYKGVGWRSDFSPTHFDRFSPPDFYTKVCIAGVGADSVKMKTSVKMDNWYPVWDEEFEFQLTVPELALLRIEVKDKDKGSDDFAGQTC

SEQ ID NO: 689 - protein, 92 aa, Artificial Sequence
  Synthetically generated peptide
LKVKVYKGVGWSSDFSPTHFDRFSPPDFYTKVSIAGVRADCAKKKTSVKMDNWNPIWDEEFEFRLTVPELALLRIEVKDKDQTKDDFAGQTC

SEQ ID NO: 690 - protein, 93 aa, Artificial Sequence
  Synthetically generated peptide
LKVKVYMGKGWDSGFQRTCFNTWSSPNFYTRVGITGVRGDKVMKKTKKEQKTWEPFWNEEFEFQLTVPELALLRIEVHDYNMPEKDDFSGQTC

SEQ ID NO: 691 - protein, 93 aa, Artificial Sequence; identical to SEQ ID NO: 690
  Synthetically generated peptide

SEQ ID NO: 692 - protein, 73 aa, Artificial Sequence
  Synthetically generated peptide
DLFSPPDFFTRLLVTGVPADVAKWKTSVIDDVWEPHWNEDHEFYLKCPELALLRIEVRDHDEGSQDEFEGQAC

SEQ ID NO: 693 - protein, 92 aa, Artificial Sequence
  Synthetically generated peptide
LKVKIYMGDGWIVDFKKRIGRLSKPDLYVRISIAGVPHDEKIMNTTVKNNEWKPTWGEEFTFPLTYPDLALISFEVYDYEVSTPDYFCGQTC

SEQ ID NO: 694 - protein, 92 aa, Artificial Sequence; identical to SEQ ID NO: 693
  Synthetically generated peptide

SEQ ID NO: 695 - protein, 92 aa, Artificial Sequence
  Synthetically generated peptide
LKVKIYMGDGWIVDFKKRIGRLSKPDLYVRISIAGVPHDENIMKTTVKNNEWTPTWGEEFTFPLTYPDLALISFEVYDYEVSTADAFCGQTC

SEQ ID NO: 696 - protein, 92 aa, Artificial Sequence; identical to SEQ ID NO: 695
  Synthetically generated peptide

SEQ ID NO: 697 - protein, 89 aa, Artificial Sequence
  Synthetically generated peptide
LKVTVLLGTDWHKNYDVFKKPGYFVKVAIHGMHDDEQKFKTHVCKRSREPHWEVEEFVFQIRVPKLAILRLEVREYDRIVRDDMVGQSC

SEQ ID NO: 698 - protein, 70 aa, Artificial Sequence
  Synthetically generated peptide
KQSVGNPSVFCKITLGNNPPRQTKVISTGPNPEWDESFSWSFESPPKGQKLHISCKNKSKMGKSSFGKVT

SEQ ID NO: 699 - protein, 81 aa, Artificial Sequence
  Synthetically generated peptide
LVVTIKRGNNMKQSVGNPSVFCKITLGNNPPRQTKVISTGPNPEWDESFSWSFESPPKGQKLHISCKNKSKMGKSSFGKVT

SEQ ID NO: 700 - protein, 81 aa, Artificial Sequence
  Synthetically generated peptide
LVVIIKRGNNMKQSVGNPSVYCKITLGNNPPRLTKVVSTGPNPEWDESFSWSFESPPKGQKLHISCKNKSKVGKSKFGKVT

SEQ ID NO: 701 - protein, 81 aa, Artificial Sequence
  Synthetically generated peptide
LVVIVKRGNNMRQSVGIPSVYCKITLGNSPPKLTKVVSTGPNPEWEESFTWSFESPPKGQKLHISCKNKSKVGKSKFGKVT

SEQ ID NO: 702 - protein, 81 aa, Artificial Sequence
  Synthetically generated peptide
LTVTIKRGNNLRQSVGNPSAFCKLTLGNNPPRLTKIVSTGATPEWDEAFAWAFDSPPKGQKLHISCKNNSKFGKKSFGKVT

SEQ ID NO: 703 - protein, 81 aa, Artificial Sequence
  Synthetically generated peptide
LTVNVMRANNLKQSMATTNAFCQLTIGNCPPRQTKVVSNSTTPEWKEGFTWAFDVPPKGQKLHIICKSKSTFGKTTLGRVT

SEQ ID NO: 704 - protein, 81 aa, Artificial Sequence; identical to SEQ ID NO: 703
  Synthetically generated peptide

SEQ ID NO: 705 - protein, 81 aa, Artificial Sequence
  Synthetically generated peptide
LTVTILRGNNLKQTMGSTNAFCCLQIGNGPPRQTKVVNNSICPVWNEGFTWLFDIPPKGQKLYILCKSKNTFGKSTLGRVT

SEQ ID NO: 706 - protein, 77 aa, Artificial Sequence
  Synthetically generated peptide
LTVAIKRGDNLKRSNAFCRLIIDNCPTKKTKVVKRSSSPVWKESFTWDFAAPPRGQFLEIVCKSNNIFRNKNLGKVR

SEQ ID NO: 707 - protein, 88 aa, Artificial Sequence
  Synthetically generated peptide
LEVYVHQARDIHNICIYHKQDVYAKLCLTSDPDKSVSTKIINGGGRNPVFDDNVKLDVRVLDTSLKCEIYMMSRVKNYLEDQLLGFTL

SEQ ID NO: 708 - protein, 88 aa, Artificial Sequence; identical to SEQ ID NO: 707
  Synthetically generated peptide

SEQ ID NO: 709 - protein, 88 aa, Artificial Sequence; identical to SEQ ID NO: 707
  Synthetically generated peptide

SEQ ID NO: 710 - protein, 88 aa, Artificial Sequence
  Synthetically generated peptide
LEVFVHQARDIHNICIYHKQDVYAKLCLTNDPENSLSTKIINGGGQNPVFDDTLQFDVKNLDCSLKCEIFMMSRVKNYLEDQLLGFSL

SEQ ID NO: 711 - protein, 88 aa, Artificial Sequence; identical to SEQ ID NO: 710
  Synthetically generated peptide

SEQ ID NO: 712 - protein, 88 aa, Artificial Sequence; identical to SEQ ID NO: 710
  Synthetically generated peptide

SEQ ID NO: 713 - protein, 88 aa, Artificial Sequence
  Synthetically generated peptide
LDVFVHQARDIHNICIYHKQDVYAKLCLTSDPDVSCSTKVINGGGRNPVFDDGLRLDVRTVDASLKCEIWMLSRVRNYLEDQLLGFAL

SEQ ID NO: 714 - protein, 88 aa, Artificial Sequence
  Synthetically generated peptide
VDVYIHQARDIHKICIYHKQDVYAKISLTSDPENSVNTKIINGGGRNPVFNDNLRLSVRTVDSSLKCEIWMLSRVKNYLEDQLLGFAL

SEQ ID NO: 715 - protein, 90 aa, Artificial Sequence
  Synthetically generated peptide
VDVHVQSARDIQNICIYHKQDVYARLSLPGEGAPAASTQVINGGGRNPVFDQSLRLGVRAGDVDGALRCEVWMLSRVKNYLQDQLLGFAL

SEQ ID NO: 716 - protein, 91 aa, Artificial Sequence
  Synthetically generated peptide
LQVYVHNARNINNICIYDNQDVYAKFSLTYNPDDTISTRIIHRAGKNPEFNQKLMIDVTQIDAHAAVLKCEIWMMSRARHYMEDQLLGFAL

SEQ ID NO: 717 - protein, 94 aa, Artificial Sequence
  Synthetically generated peptide
LDIYVHGARGIHNICIYAAQDVYARLALTSSPDDAPALDTRVAAGGGANPRFDERLPPLRVRRARLGTDVLKCEIWMRSCARRLLDDQLLGFAL

SEQ ID NO: 718 - protein, 85 aa, Artificial Sequence
  Synthetically generated peptide
LEIEVISAEGLKVDRKPLKKKTYSVVRIDEKSWASKVDELGGSYPIWKDRFDMEMPINASVRFISIEVYYRTSGSGRDKNVGYAK

SEQ ID NO: 719 - protein, 85 aa, Artificial Sequence; identical to SEQ ID NO: 718
  Synthetically generated peptide

SEQ ID NO: 720 - protein, 85 aa, Artificial Sequence
  Synthetically generated peptide
  misc_feature (26)..(26): Xaa can be any naturally occurring amino acid
LEIEVISAEGLKVDRKPLKKKTYSVXRIDEKSWASKVDELGGSYPIWKDRFDMEMPINASVRFISIEVYYRTSGSGRDKNVGYAK

SEQ ID NO: 721 - protein, 82 aa, Artificial Sequence
  Synthetically generated peptide
LEIDLRSAEGLKLNRRPIKKKTFAVVKIDEKCRKSNLDESRRSNPTWNYKSEMPINGNEQFIFIEVFYRTGSGHDKKIGEAK

SEQ ID NO: 722 - protein, 82 aa, Artificial Sequence; identical to SEQ ID NO: 721
  Synthetically generated peptide

SEQ ID NO: 723 - protein, 82 aa, Artificial Sequence; identical to SEQ ID NO: 721
  Synthetically generated peptide

SEQ ID NO: 724 - protein, 95 aa, Artificial Sequence
  Synthetically generated peptide
LEVTLISAQGLKPPSGLRRRLLQAYAVAWVDAARRLQTRPDRAGGVDPEWHERLLFRVHEAALADDSRAAVTVEIYAAPAGGWHIGGDSLVGSAR

SEQ ID NO: 725 - protein, 88 aa, Artificial Sequence
  Synthetically generated peptide
LEVTVISAQDLHRRLGRRVRAAYAVAWADAAHKLRTGVDLAGGADPTWNDRFLFRVEEAFLRSDTAAVTVEVRAPRRFGGDAVLGVTR

SEQ ID NO: 726 - protein, 85 aa, Artificial Sequence
  Synthetically generated peptide
LELNIISAQDLAPVSRKMKTYAVAWVHSERKLTTRVDYTGGGNPTWNDKFVFRVSEDFLYADTSAVVVEIYALHWFRDVHVGTVR

SEQ ID NO: 727 - protein, 85 aa, Artificial Sequence
  Synthetically generated peptide
LELNIISAQDLAPVARKTKTYAVAWVHSERKLTTRVDYNGGTNPTWNDKFVFRVNEEFLYADTSAVVIEIYALHWFRDVHVGTVR

SEQ ID NO: 728 - protein, 85 aa, Artificial Sequence
  Synthetically generated peptide
LELNIISAQELAPVARCMKTYAIAWIDPERKLTTRVDNTGGTSPTWNDKFVFRLDEEALYDATSIVVIEIYALHWFKDIHVGTVQ

SEQ ID NO: 729 - protein, 85 aa, Artificial Sequence
  Synthetically generated peptide
LELNVISAQDLAEVGRSMRTYAVAWVDPDRKLSTRVDSQSGTNPAWNDKFVFRVDEDFLYDENSTITIDIYAIHWFKDIHVGTAH

SEQ ID NO: 730 - protein, 87 aa, Artificial Sequence
  Synthetically generated peptide
LEINLISAQDLAPVSRNMKTYSVAWINTDPMRKLTTRVDQSNRANPIWNEKFVFRVNDKILYVDASAIVIEIYAAAWAKDALVGTVN

SEQ ID NO: 731 - protein, 87 aa, Artificial Sequence
  Synthetically generated peptide
LEINLISAQDLAPVSRNMKTYSVAWINTDPMRKLTTRVDQSNRANPIWNEKFVFRVNDKILDVDASAIVIEIYAAAWAKDALVGTVN

SEQ ID NO: 732 - protein, 88 aa, Artificial Sequence
  Synthetically generated peptide
LEINLISAQGLKEPTGKLRRLQTYASVWVDSSSKLRTRIDRIGSENPIWNDKFVFQVSPEFLSSETSGVSIEIYAVGYLRDHLIGTVR

SEQ ID NO: 733 - protein, 91 aa, Artificial Sequence
  Synthetically generated peptide
LEVTVVSGKHLKNVNWRRGDLRAYVVAYLDPSRRAATRPDDVGGCKPAWNERVVLPLPPHLSPHDPSLLLSLDVFHSKPSDSPKPLVGSAR

SEQ ID NO: 734 - protein, 87 aa, Artificial Sequence
  Synthetically generated peptide
LVVTVVSAKHLKNVNWRNGDLKPYVVLYLDQDHPLSTRSDDSSSIKPVWNERITLPLTRSVHESVLNIEVFHSNSSDLAKTLVGSVR

SEQ ID NO: 735 - protein, 89 aa, Artificial Sequence
  Synthetically generated peptide
VEVTVSSARDLKNVNWRNGDLKPYAVLWVDDGAKCSTRVDLDNADNPNWDDKLTLPLPPSSRLDDALLYLDVVHANAAEGVKPLVGSAR

SEQ ID NO: 736 - protein, 89 aa, Artificial Sequence
  Synthetically generated peptide
VEVTVASARDLKNVNWRNGDLKPYAVVWIDDGAKCSTRVDLDNADNPTWDDKLTVPLPPSTRLDDAVLYLDVVHANAAEGVKPLVGSAR

SEQ ID NO: 737 - protein, 89 aa, Artificial Sequence
  Synthetically generated peptide
VEVTVGAARDLKNVNWRNGDLKPYAVLWIDAGARCSTRVDLDNGENPTWDDKVVVPLPPASRLQDAVLYLDIVHANAPEGVKPLVGSAR

SEQ ID NO: 738 - protein, 88 aa, Artificial Sequence
  Synthetically generated peptide
VEVTISSAKDIKNVNWRNGPNKPYAVVWIDPKFKSSTRVDEDGNTCTTWNETFVIALPPANDDDDKVYINIVHAGREENTKPLIGSAH

SEQ ID NO: 739 - protein, 88 aa, Artificial Sequence; identical to SEQ ID NO: 738
  Synthetically generated peptide

SEQ ID NO: 740 - protein, 92 aa, Artificial Sequence
  Synthetically generated peptide
LELTLLSASDLRGVNLVSKMEVYAVVYLAGDPRARQRVATDRAGGRNPSWKGKDATVRLAVPASGAGSGAVRVLLRAERAGLGGDRDVGEVF

SEQ ID NO: 741 - protein, 86 aa, Artificial Sequence
  Synthetically generated peptide
LELTLISAKDLKDVNLLSKMEVYAVVSLSGDRRSRQRIATDRAGGRNPAWNAAPLRFTVPASGAGSLHVLLRAERALGDRDVGEVH

SEQ ID NO: 742 - protein, 86 aa, Artificial Sequence
  Synthetically generated peptide
LEVTLISARNLKKVNLITPMEVYAVVSVSGNPLARQCTLPDRHGGRNPTWNATLHLAVPAAAPGAFLHVLLRTERALGDRDVGEVF

SEQ ID NO: 743 - protein, 88 aa, Artificial Sequence
  Synthetically generated peptide
LEVTLHSARDLKNVNFISRMEVYAVATISGDPLTRQCTPPDPYGGRHPAWNATLRFTVPPTAASAAGCLHVLLRAERSLGDRDIGEVI

SEQ ID NO: 744 - protein, 91 aa, Artificial Sequence
  Synthetically generated peptide
LELTLVSASDLKKVTLFSRMHVYAVASISGSNVPMPMHGTHADRNGGSNPAWNTVLHFPVPARFDTRGLALHVQLRARRSFGGHRDVGDVF

SEQ ID NO: 745 - protein, 91 aa, Artificial Sequence; identical to SEQ ID NO: 744
  Synthetically generated peptide

SEQ ID NO: 746 - protein, 91 aa, Artificial Sequence
  Synthetically generated peptide
LEVTLVSAKNLKKVTMFSKMRVYAVASISGGDPRVPTHRTHADREGGRSPMWHAPLRFPIPDAGADMRAIALHVLLRAERVFGDSDVGEVF

SEQ ID NO: 747 - protein, 92 aa, Artificial Sequence
  Synthetically generated peptide
LELNVYSAKDLENVNLITKMDVYAVVWITGDDSRKNHKEKTPIDRTGESEPTWNHTVKFSVDQRLAHEGRLTLVVKLVCDRIFGDKDLGEVQ

SEQ ID NO: 748 - protein, 94 aa, Artificial Sequence
  Synthetically generated peptide
LELKIVSASDVNHIDATDKMDVYAVVSINGDTTQQKQAAKTPIDYDGGSNPTWNHTVKFSVNEREANEGLLTITVKLFSYWLEGDNDLYLGEVN

SEQ ID NO: 749 - protein, 92 aa, Artificial Sequence
  Synthetically generated peptide
LELNINSARNLLNVNLITKMNVFTAITINGENTRKKQKAKTTVDRYGGSNPTWNQTIKFSVDERSARGGHSSLVMRVISRRVLGNKEIGRVN

SEQ ID NO: 750 - protein, 91 aa, Artificial Sequence
  Synthetically generated peptide
LELNIISAKDIKNVNLFSKMDVYAAVSLSGDPLHPQGATTHVHKDAGSNPTWNYPVKFSVNESLAKENRLSLEIKLISDRTLGDTVIGTVH

SEQ ID NO: 751 - protein, 92 aa, Artificial Sequence
  Synthetically generated peptide
LELVIKFAKNIEDVNAFSSMDVYASVAILKDRKVKNRINTPVAFAAYTNPKWNQMMKFSIDEKSAQEGRLMLLVELMSHRPFLGDKEIGFVR

SEQ ID NO: 752 - protein, 90 aa, Artificial Sequence
  Synthetically generated peptide
LDLTIISAEDLKDVQLIGKQDLYAVVSINGDARTKQKTKVDKDCGTKPKWKHQMKLTVDDAAARDNRLTLVFEIVADRPIAGDKPVGEVS

SEQ ID NO: 753 - protein, 90 aa, Artificial Sequence; identical to SEQ ID NO: 752
  Synthetically generated peptide

SEQ ID NO: 754 - protein, 99 aa, Artificial Sequence
  Synthetically generated peptide
LELTVYEADDLHNAIHGRIIKAAESLKESLGVHRLAHRIYVDVDVGAARVARTREVEFHPTNPVWNQSFRLHCAYPAAPVAFTVKSQHLVGAGVLGAAR

SEQ ID NO: 755 - protein, 99 aa, Artificial Sequence; identical to SEQ ID NO: 754
  Synthetically generated peptide

SEQ ID NO: 756 - protein, 38 aa, Artificial Sequence
  Synthetically generated peptide
SPKWNETFHIYSAHSISNIIFTVKQDNPIGATLIGRAY

SEQ ID NO: 757 - protein, 60 aa, Artificial Sequence
  Synthetically generated peptide
YATVDLDKARVGRTRMIGNQPSNPKWNETFEIYCAHYISNIVFTVKDDNPIGATLIGRAY

SEQ ID NO: 758 - protein, 100 aa, Artificial Sequence
  Synthetically generated peptide
LHVTIFEVDHLKAGSVVVFSESLRRTLRKPLVLAKGTPKIYASIDLDKARVGRTRMIENEPNNPKWNESFHIYCGHPSTNVIFTVKDDNPIGATLIGRAY

SEQ ID NO: 759 - protein, 100 aa, Artificial Sequence
  Synthetically generated peptide
LHATIFEVDKLKNIGGGNILSKIRQNFEETVGFGKGTTKLYATIDLEKARVGRTRIIEKEHVNPQWNESFHIYCAHLASDIIFTVKDDNPIGATLIGRAY

SEQ ID NO: 760 - protein, 100 aa, Artificial Sequence; identical to SEQ ID NO: 759
  Synthetically generated peptide

SEQ ID NO: 761 - protein, 100 aa, Artificial Sequence
  Synthetically generated peptide
LHATIYEVDELHGGGGGNFFSKLKQNIEETVGIGKGVTKLYATIDLEKARVGRTRIIENETTNPKWNESFHIYCGHLASNIIFTVKDDNPIGATLIGRAY

SEQ ID NO: 762 - protein, 100 aa, Artificial Sequence
  Synthetically generated peptide
LHATIYEIDRLHTGGSSNVFSMLRQNFEEAVGIGKGQTKLYATIDLEKARVGRTRILESEPSNPRWYESFHIYCAHKASNVIFTVKDDNPIGATLIGRTY

SEQ ID NO: 763 - protein, 100 aa, Artificial Sequence
  Synthetically generated peptide
LHVTIYEVDQLHSGGGGNFFTKLKANIEETVGFGKGTPKIYASIDLEKARVGRTRMIEHEPNNPRWYESFHIYCAHMASNVIFTVKDDNPIGATLIGRAY

SEQ ID NO: 764 - protein, 100 aa, Artificial Sequence
  Synthetically generated peptide
LHVTVYEVDRLHAGGGGNIFSKLRANIEEKVGFGKGTPKIYASIDLEKARVGRTRMIEHEPTNPRWYESFHIYCAHLASNIIFTVKDDNPIGATLIGRAY

SEQ ID NO: 765 - protein, 100 aa, Artificial Sequence
  Synthetically generated peptide
LHVTVYEVDKLREGGGPNVFGKLMANIQETVGFGEGTPKIYATIDLEKSRVGRTRMIENEPQNPRWYESFHIYCAHHASNIIFTVKDDNPIGATLLGRAY

SEQ ID NO: 766 - protein, 100 aa, Artificial Sequence
  Synthetically generated peptide
LHVTIYEVDKLHSGGGPHFFRKLVENIEETVGFGKGVSKLYATIDLEKARVGRTRILENEQSNPRWYESFHVYCAHQASNVIFTVKDDNPIGATLIGRAY

SEQ ID NO: 767 - protein, 99 aa, Artificial Sequence
  Synthetically generated peptide
LHVTIYEVDKLKTSGGNVFTKLVQNIEETVGFGKGVTKLYATIDLEKARVGRTRIIEKDHSNPRWYESFHIYCAHMASNIIFTVKDDNPIGATLIGRAY

SEQ ID NO: 768 - protein, 101 aa, Artificial Sequence
  Synthetically generated peptide
LHATIYEVDDLHTGGLRSGFFGKILANVEETIGVGKGETQLYATIDLQRARVGRTRKIKDEAKNPKWYESFHIYCAHLASDIIFTVKDDNPIGATLIGRAY

SEQ ID NO: 769 - protein, 60 aa, Artificial Sequence
  Synthetically generated peptide
YATIDLQKARVGRTRKIKNEPKNPKWYESFHIYCAHLASDIIFTVKDDNPIGATLIGRAY

SEQ ID NO: 770 - protein, 60 aa, Artificial Sequence
  Synthetically generated peptide
YATIDLQKARVGRTRKITDEPKNPKWYESFHIYCAHMASDIIFTVKDDNPIGATLIGRAY

SEQ ID NO: 771 - protein, 101 aa, Artificial Sequence
  Synthetically generated peptide
LHATIYEVDHLHAEGGRSGFLGSILANVEETIGVGKGETQLYATIDLEKARVGRTRKITKEPKNPKWFESFHIYCGHMAKHVIFTVKDANPIGATLIGRGY

SEQ ID NO: 772 - protein, 101 aa, Artificial Sequence
  Synthetically generated peptide
LHVTIFEVDNLQGEEEGGHFFSKIKQHFEETVGIGKGTPKLYATIDLEKARVGRTRIIENEPKNPRWYESFHIYCAHMASNVIFTIKDDNPFGASLIGRAY

SEQ ID NO: 773 - protein, 101 aa, Artificial Sequence; identical to SEQ ID NO: 772
  Synthetically generated peptide

SEQ ID NO: 774 - protein, 100 aa, Artificial Sequence
  Synthetically generated peptide
LHVTIYEVDNLQKEGGGHFFSKIKEHVEETIGFGKGTPAIYATVDLEKARVGRTRKIKNEPNNPRWYESFHIYCAHMASNVIFTVKDDNPIGATLIGRAY

SEQ ID NO: 775 - protein, 99 aa, Artificial Sequence
  Synthetically generated peptide
LHATIYEVDKLHGSSGNFLRKITGKLEETVGLGKGVSKLYATVDLERARVGRTRVIEKEPSNPNWSESFHIYCAHVAANVIFTVKESNPIGASLIGRAY

SEQ ID NO: 776 - protein, 105 aa, Artificial Sequence
  Synthetically generated peptide
LHATIFEAASLSNPHRASGSAPKFIRKFVEGIEDTVGVGKGATKVYSTIDLEKARVGRTRMITNEPINPRWYESFHIYCAHMASNVIFTVKIDNPIGATNIGRAY

SEQ ID NO: 777 - protein, 105 aa, Artificial Sequence
  Synthetically generated peptide
LHATIFEAESLSNPHRATGGAPKFIRKLVEGIEDTVGVGKGATKIYATVDLEKARVGRTRMISNEPVNPRWYESFHIYCAHMAADVIFTVKIDNSIGASLIGRAY

SEQ ID NO: 778 - protein, 105 aa, Artificial Sequence
  Synthetically generated peptide
LHVTIFEANSISHPDRKTGGAPKFFRKLVENIEETVGFGKGASMLYASVDLDKARVGRTRIIKDEPVNPKWYESFHIYCAHMAANVIFTVKDDNPIGATLIGRAY

SEQ ID NO: 779 - protein, 105 aa, Artificial Sequence; identical to SEQ ID NO: 778
  Synthetically generated peptide

SEQ ID NO: 780 - protein, 59 aa, Artificial Sequence
  Synthetically generated peptide
YATIDLGKARVGRTRLLDEHKNPRWYESFHIYCAHMASDVVFTVKADNPIGAELIGRAY

SEQ ID NO: 781 - protein, 99 aa, Artificial Sequence
  Synthetically generated peptide
LHVTIFEVDKLRTNFGREIFNKVVQGIEGAIGFNKTASTLYATIDLGKARVGRTRLLDEHKNPRWYESFHIYCAHMASDVVFTVKADNPIGAELIGRAY

SEQ ID NO: 782 - protein, 99 aa, Artificial Sequence
  Synthetically generated peptide
LHVTIFEVDRLHTNFGRDFFNKVVQGIEGAIGFNKAASRLYATIDLGKARVGRTRLLDDHKNPRWYESFHIYCAHMAANVIITVKFDNPIGAEVIGRAY

SEQ ID NO: 783 - protein, 59 aa, Artificial Sequence
  Synthetically generated peptide
YATVDIDKARVARTRTVEPTGTPRWKESFHIYCAHYAGDVIFTVKAENPVGATLIGRAY

SEQ ID NO: 784 - protein, 105 aa, Artificial Sequence
  Synthetically generated peptide
MHVTIFEAESLSNPSRPSSQAPQFLRKLVEGIEDTVGVGKGTSKVYATIGLDKARVGRTRTLADDTAAPRWYESFHVYCAHLATHVAFTLKAKNPIGASLLGVGY

SEQ ID NO: 785 - protein, 91 aa, Artificial Sequence
  Synthetically generated peptide
LEATILEADHLSNPTRATGAAPGIFRKFVEGFEDSLGLGKGATRLYATIDLGRARVGRTRVVDDEPVNPRWYEVFHIYCAHFAADVVFSVK

SEQ ID NO: 786 - protein, 105 aa, Artificial Sequence
  Synthetically generated peptide
LEATILEADHLSNPTRATGAAPGIFRKFVEGFEDSLGLGKGATRLYATIDLGRARVGRTRVVDDEPVNPRWYEVFHIYCAHFAADVVFSVKAAQPIGATLIGRAY

SEQ ID NO: 787 - protein, 109 aa, Artificial Sequence
  Synthetically generated peptide
LDATIFEATNLTNPTRLTGNAPEGFRKWWEGLENGLEKTTGLGPGGTRLYATVDLGRARLGRTRVIDDEPVSPRWDERFHFYCAHFAENVVFSVKVALSVDAKLIGRAY

SEQ ID NO: 788 - protein, 109 aa, Artificial Sequence; identical to SEQ ID NO: 787
  Synthetically generated peptide

SEQ ID NO: 789 - protein, 105 aa, Artificial Sequence
  Synthetically generated peptide
LDATIFEATNLTNPTRLTGSAPEGIRKWWEGVEKTTGVGQGGTRLYATVDLGKARLGRTRVIDDEPVNPRWDERFHLYCAHFADNVVFSVKVSLPIDAALIGRAY

SEQ ID NO: 790 - protein, 105 aa, Artificial Sequence; identical to SEQ ID NO: 789
  Synthetically generated peptide

SEQ ID NO: 791 - protein, 115 aa, Artificial Sequence
  Synthetically generated peptide
LDLTIVEARRLPNMDFMVNHLRSCLTCEPCKSPAQTAAKEGDSKIRGHRKIITSDPYVTVCLPQATVARTRVLKNSQNPKWNEHFIIPLAHPVTELDINVKDNDLFGADAIGTAK

SEQ ID NO: 792 - protein, 115 aa, Artificial Sequence; identical to SEQ ID NO: 791
  Synthetically generated peptide

SEQ ID NO: 793 - protein, 118 aa, Artificial Sequence
  Synthetically generated peptide
LDLTIIEARKLPNMDIVSNHLRKCLTCETCKAPSQAAAAQEPGEVGKVHHHHKIMTSDPYVTITVPQSTLARTPVLKSADNPEWNERFIIPMAHPLTELEINVKDDDLLGAEVIGTTK

SEQ ID NO: 794 - protein, 123 aa, Artificial Sequence
  Synthetically generated peptide
LDLKIVKARRLPNMDMFSEHLRRLFTACNACARPTDTDDVDPRDKGEFGDKNIRSHRKVITSDPYVTVVVPQATLARTRVLKNSQEPLWDEKFNISIAHPFAYLEFQVKDDDVFGAQIIGTAK

SEQ ID NO: 795 - protein, 123 aa, Artificial Sequence; identical to SEQ ID NO: 794
  Synthetically generated peptide

SEQ ID NO: 796 - protein, 123 aa, Artificial Sequence; identical to SEQ ID NO: 794
  Synthetically generated peptide

SEQ ID NO: 797 - protein, 115 aa, Artificial Sequence
  Synthetically generated peptide
LDLWVVEARLLPNMDMFSEHVRRCFAACKPPTSCATARQPRHARGHHRRKIITSDPYVTLSVAGAVVARTRVIPNDQDPVWDERFAVPLAHYAAALEFHVKDNDTFGAQLIGTVT

SEQ ID NO: 798 - protein, 116 aa, Artificial Sequence
  Synthetically generated peptide
LDIWITEAKCLPNMDIMSERMRRFFTGYGACGSSCAGDNARRGGVGVRPKKIITSDPYVSVCLAGATVAQTRVIPNSENPRWEERFRVEVAHAVSRLEFHVKDNDVFGAQLIGVAS

SEQ ID NO: 799 - protein, 118 aa, Artificial Sequence
  Synthetically generated peptide
LDIWITEAKCLPNMDIMSERMRRFFTGYGACGSSCGGTGDNARRAGGGVRPKKIITSDPYVSVCLAGATVAQTRVIPNSENPRWEERFRVEVAHAVSRLEFHVKDNDVFGAQLIGVAS

SEQ ID NO: 800 - protein, 111 aa, Artificial Sequence
  Synthetically generated peptide
LDIQIVEAKCLPNMDLMTERMRKCFTGYGACSTECGKSDPHTDVRKIITSDPYVSVCLSGATVAQTRVIANSENPKWDEHFYVQVAHSVSRVEFHVKDNDVFGAELIGVAS

SEQ ID NO: 801 - protein, 112 aa, Artificial Sequence
  Synthetically generated peptide
LDLFIIEAKSLPNLDLSTEAIRKCLTMGNSCTPPFVKGLKTHSGKDKIITSDPYVSICLAGATIAQTRVIPNCENPLWDEHFLVPVAHPAHKIEFLVKDNDILGAELIGVVE

SEQ ID NO: 802 - protein, 85 aa, Artificial Sequence
  Synthetically generated peptide
LMVELLHGRRIRKVDGEKSSKFTSDPYVTVSISGAVIGRTFVISNSENPVWMQHFDVPVAHSAAEVHFVVKDNDPIGSKIIGVVG

SEQ ID NO: 803 - protein, 108 aa, Artificial Sequence
  Synthetically generated peptide
LDIWVKEAKHLPNMICYRNKLVGGISFSELGRRIRKVDGEKSSKFTSDPYVTVSISGAVIGRTFVISNSENPVWMQHFDVPVAHSAAEVHFVVKDNDPIGSKIIGVVG

SEQ ID NO: 804 - protein, 104 aa, Artificial Sequence
  Synthetically generated peptide
LDIWVKEAKHLPNMDGFHNRLGGMLSGLGRKKVEGEKSSKITSDPYVTVSISGAVIGRTFVISNSENPVWMQHFDVPVAHSAAEVHFVVKDSDIIGSQIMGAVG

SEQ ID NO: 805 - protein, 107 aa, Artificial Sequence
  Synthetically generated peptide
LDIWVKEAKHLPNMDGFHNTLVGGMFFGLGRRNHKVDGENSSKITSDPYVTVSISGAVIGRTFVISNSENPVWMQHFDVPVAHSAAKVHFVVKDSDIIGSQIIGAVE

SEQ ID NO: 806 - protein, 104 aa, Artificial Sequence
  Synthetically generated peptide
LDIWVREAKNLPNMDLFHKKLDNLLGGLAKLGSKKEGSPKITSDPYVTVSVSNAVVARTYVINNSENPIWMQHFYVPVAHYASEVHFVVKDNDVVGSQIIGAVG

SEQ ID NO: 807 - protein, 103 aa, Artificial Sequence
  Synthetically generated peptide
LDIWVSCANNLPNLDLFHKTLGVVFGGMTNMIEGQLSKKITSDPYVSISVAGAVIGRTYVISNSENPVWQQHFYVPVAHHAAEVHFVVKDSDAVGSQLIGIVT

SEQ ID NO: 808 - protein, 103 aa, Artificial Sequence
  Synthetically generated peptide
LDIWIYHAKNLPNMDMFHKTLGDMFGRLPGKIEGQLTSKITSDPYVSVSVAGAVIGRTYVMSNSENPVWMQHFYVPVAHHAAEVHFVVKDSDVVGSQLIGLVT

SEQ ID NO: 809 - protein, 95 aa, Artificial Sequence
  Synthetically generated peptide
LEIWVYEAKNLPNMDMFHKTIGDMFGQMSNKITSDPYVSINIADATIGRTYVINNNENPVWMQHFNVPVAHYAAEVQFLVKDDDIVGSQLMGTVA

SEQ ID NO: 810 - protein, 107 aa, Artificial Sequence
  Synthetically generated peptide
  misc_feature (86)..(86): Xaa can be any naturally occurring amino acid
LDIWVLEANNLPNMDMFHRTLGDMFANFSSNISKKVGGRSDEKITSDPYVTIAVAGAVIGRTFVISNNENPVWMQHFNVPVAHHAXEVQFVVKDSDILGSDIIGVVA

SEQ ID NO: 811 - protein, 107 aa, Artificial Sequence
  Synthetically generated peptide
LDIWVLEANNLPNMDMFHRTLGDMFANFSSNISKKVGGRSDEKITSDPYVTIAVAGAVIGRTFVISNNENPVWMQHFNVPVAHHAAEVQFVVKDSDILGSDIIGVVA

SEQ ID NO: 812 - protein, 107 aa, Artificial Sequence
  Synthetically generated peptide
LDIWVLEAKNLPNMDMFHKTLGDMFGNFSSNISKKIGGRSEGKNTSDPYVTIAVSGAVIGRTFVINNDENPVWRQHFYVPVAHHAAEVQFVVKDIDILGSEIIGVVT

SEQ ID NO: 813 - protein, 105 aa, Artificial Sequence
  Synthetically generated peptide
LDVWVYDARNLPNKDLFSKRVGDLLGPRLIGAVGSKMSSANMTSDPYVTIQVSYATVARTYVVPNNENPVWTQNFLVPVGHDAAEVEFVVKDNDVFGAQLIGTVS

SEQ ID NO: 814 - protein, 105 aa, Artificial Sequence; identical to SEQ ID NO: 813
  Synthetically generated peptide

SEQ ID NO: 815 - protein, 101 aa, Artificial Sequence
  Synthetically generated peptide
LDIWIHEARNLPNMDIVSKTVVDILGTKKKKKAANGAMTSDPYVTVQLASATVARTYVVNDDENPVWAQHFLIPVAHEAPAVHFLVKDSDVFGAELIGEVV

SEQ ID NO: 816 - protein, 101 aa, Artificial Sequence; identical to SEQ ID NO: 815
  Synthetically generated peptide

SEQ ID NO: 817 - protein, 124 aa, Artificial Sequence
  Synthetically generated peptide
LDLTIHEARGLPNMDFLSTLLRRLCLCLRPPARRPSPGQSRGSVPADEDGRRQPHGHHLLPTSDPYAAVVVAGNTLARTHVVRDSEDPEWSTHVLLHLAHHATGVAFHVKDADPFGSDLIGVAI

SEQ ID NO: 818 - protein, 64 aa, Artificial Sequence
  Synthetically generated peptide
YVNIQFGDQIFTSKITQGKGKKVWWNEKFRFPLSSDECKELAKVTLKIMERDKFSEDSLVGETK

SEQ ID NO: 819 - protein, 64 aa, Artificial Sequence
  Synthetically generated peptide
LDVTLKSASDLREDMSVKLDAYCVVSCASTAHRSNTVTDAGKTMNWEQTFHFDKVASTSVLKLE

SEQ ID NO: 820 - protein, 92 aa, Artificial Sequence
  Synthetically generated peptide
LEINVTSAKGLKKVSKMDVFVAVKLSGDPKCSDHREQRTQAARDGGTSPKWSNDVMKFILDQNLAEANRLVITFKIKCEQRGGVDKDIGEVH

SEQ ID NO: 821 - protein, 90 aa, Artificial Sequence
  Synthetically generated peptide
VEINVLSAQDLNSINLLFRPTVYVSVSVTRGSRDKQVTPAAAWDKKFLRWNYRMKFYIEDDKVRRNESVFVFQIKCKRFFGSDQVVGKLF

SEQ ID NO: 822 - protein, 82 aa, Artificial Sequence
  Synthetically generated peptide
LYVYILQAKDLPAKETFAKLHVGRHKSKTRVARDTSSPIWNEEFVFRISDVDEGDDVVVSILHHEQQDHQSIVSTGLIGKVR

SEQ ID NO: 823 - protein, 84 aa, Artificial Sequence
  Synthetically generated peptide
LYIRVAKAKRAKNDGSNPVYAKLVIGTNGVKTRSQTGKDWDQVFAFEKESLNSTSLEVSVWSEEKIEKEDKTTTTTESCLGTVS

SEQ ID NO: 824 - protein, 104 aa, Artificial Sequence
  Synthetically generated peptide
MTVQILEAKGLHIIDDGNSHSFFCTLRLVVDSQGAEPQKLFPQSARTKCVKPSTTIVNDLMECTSKWNELFIFEIPRKGVARLEVEVTNLAAKAGKGEVVGSLS

SEQ ID NO: 825 - protein, 101 aa, Artificial Sequence
  Synthetically generated peptide
IDLKIISCKDINAFNFFQKLTLYAQVSISTTNPKTKLTKQQQRTPTHRDTDDDGTNPEWNHQTRFNLSFLSSHPDPSEFFLSFERRHDGLILGNKFLGECR

SEQ ID NO: 826 - protein, 84 aa, Artificial Sequence
  Synthetically generated peptide
VTIRSISCRGVKAFVPFQKPPLYAAVSLAGRREKTSGDPDGGENPDWDAAVFAFDLPAAADGMLQFEVKAQVPLLGSKLVGKVS

SEQ ID NO: 827 - protein, 91 aa, Artificial Sequence
  Synthetically generated peptide
FELRIIQARNIESVKSTKNLFARLYLPTGNNKRIQLNSKSVSTKSVPFWDESFNLDCSCPQEFLENLNQQSLEVELRQRKIWGSQLIGKFE

SEQ ID NO: 828 - protein, 102 aa, Oryza sativa
MSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 829 - protein, 134 aa, Zea mays
MRKHRIVSLVAALLILLALAVSSTRNAQEDSMADNTGTLAGGIKDVPGNENPLHLQELARFAVDEHNKKANALLGFEKLVKAKTQVVAGTMYYLTIEVKDGEVKKLYEAKVWEKPWENFKELQEFKPVDEGASA

SEQ ID NO: 830 - protein, 125 aa, Triticum aestivum
LLAIVVPFTQTRTQSARDKAAMAEDAGPLVGGIKDSPMGQENDLDVIALARFAVSEHNNKANALLEFENVVKLKKQTVAGTMHYITIRVTEGGAKKLYEAKVWEKPWENFKQLQEFKPVEDAAIA

SEQ ID NO: 831 - protein, 140 aa, Hordeum vulgare subsp. vulgare
MWKYRVLGSVAALLLLLAVVVPFTQTWTQSARDKAAMAEDAGPLMGGIEDSPMGQENDLDVIALARFAVSEHNKKANALLEFENVVKLKKQTVAGTMYYITIRVTEGGTKKLYEAKVWEKLWENFKQLEEFKPVQDAAIA

SEQ ID NO: 832 - protein, 135 aa, Coix lacryma-jobi
MRKQRIVPLVAALLVLLALAVSSTRNAREEESMADDAGMLAGGIKDVPANENDLHLQELARFAVDEHNKKANALLGYEKLVKAKTQVVAGTMYYLTIEVKDGEVKKLYEAKVWEKPWENFKELLEFKPVEEDASA

SEQ ID NO: 833 - protein, 135 aa, Zea mays
MRKHRIVSLVAALLVLLALAAVSSTRSTQKESVADNAGMLAGGIKDVPANENDLQLQELARFAVNEHNQKANALLGFEKLVKAKTQVVAGTMYYLTIEVKDGEVKKLYEAKVWEKPWENFKQLQEFKPVEEGASA

SEQ ID NO: 834 - protein, 130 aa, Sorghum bicolor
ARVVPLVAALLVLLALAVSSTRNRNAQEGEESMALDGGIKDVPANENDLHLQELARFAVDEHNKKANALLGYEKLVKAKTQVVAGTMYYLTVEVKDGEVKKLYEAKVWEKPWENFKELQEFKPVEEGASA

SEQ ID NO: 835 - protein, 97 aa, Arachis hypogaea
AAVGAPREVAGNENSLEIDSLARFAVDEHNKKQNGLLEFKRVISAKQQVVAGTLHHITLEAASGDSKNVYEAKVWEKPWMNFKEVQEFKLAGDGSNA

SEQ ID NO: 836 - protein, 100 aa, Castanea sativa
AALVGGVSDVKGHENSLQIDLARFAVDDHNKKANTLLQFKKVVNAKQQVVSGTIYILTLEVEDGGKKKVYEAKIWEKPWLNFKEVQEFKLIGDAPTHHSA

SEQ ID NO: 837 - protein, 104 aa, Saccharum officinarum
AEAHNGRRVGMVGDVRDAPAGHENLEAIELARFAVAEHNSKTNAMLEFERLVKVRHQVVAGTMHHFTVQVKEAGGGKKLYEAKVWEKVWENFKQLQSFQPVGDA

SEQ ID NO: 838 - protein, 95 aa, Vigna unguiculata
AAGGNRDVAGNQNSLEIDSLARFAVEEHNKKQNALLEFGRVVSAQQQVVSGTLYTITLEAKDGGQKKVYEAKVWEKPWLNFKELQEFKHVGDAPA

SEQ ID NO: 839 - protein, 156 aa, Oryza sativa
MAGSGVLEVHFVDAKGLTGNDFLGKIDPYVVVQYRSQERKSSVARDQGKNPSWNEVFKFQINSTAATGQHKLFLRLMDHDTFSRDDFLGEATINVTDLISLGMEHGTWEMSESKHRVVLADKTYHGEIRVSLTFTASAKAQDHAQQVGGWAHSFRQ

SEQ ID NO: 840 - protein, 144 aa, Oryza sativa
MVQGTLEVLLVGAKGLENTDYLCNMDPYAVLKCRSQEQKSSVASGKGSDPEWNETFMFSVTHNATELIIKLMDSDSGTDDDFVGEATISLEAIYTEGSIPPTVYNVVKEEEYRGEIKVGLTFTPEDDRDRGLSEEDIGGWKQSS

SEQ ID NO: 841 - protein, 138 aa, Cucurbita maxima
MGMGMMEVHLISGKGLQAHDPLNKPIDPYAEINFKGQERMSKVAKNAGPDPIWNEKFKFLVEYPGSGGDFHILFKVMDHDAIDGDDYIGDVKIDVQNLLAEGVRKGWSELPPRMYQVLAHKIYFKGEIEVGVFFQRQG

SEQ ID NO: 842 - protein, 150 aa, Cucurbita maxima
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCYPWEN

SEQ ID NO: 843 - protein, 146 aa, Arabidopsis thaliana
MPHGTLEVVLVSAKGLEDADFLNNMDPYVQLTCRTQDQKSNVAEGMGTTPEWNETFIFTVSEGTTELKAKIFDKDVGTEDDAVGEATIPLEPVFVEGSIPPTAYNVVKDEEYKGEIWVALSFKPENRSRGMDEESYGGWKNSEASY

SEQ ID NO: 844 - protein, 92 aa, Artificial Sequence
  Synthetically generated peptide
PQQVHITQGDHVGKAVIVSWVTHFEPASKVVVYWSENSKYKKSAEGTVTTYRFKNYNGYIHHCYIKGLEYDTKYYYVVFIGNTRASREFWFR

SEQ ID NO: 845 - protein, 101 aa, Artificial Sequence
  Synthetically generated peptide
PQQVHITQGDHVGKAVIVSWVTMFSPHSAKVVVYWSENSKYKKSAEGTVTTYQSTFANNSRYIHHCYIKGLEYDTKYYYVDVKFGPIGLINTRASREFWFR

SEQ ID NO: 846 - protein, 91 aa, Artificial Sequence
  Synthetically generated peptide
PQQVHITQGDHVGKAVIVSWVTMARKLSPVVVYWSENSKYKKSAEGTVTTYRDYNKTSGYIHHCYIKGLEYDTKYYYVVGIGNTSREFWFR

Figure 2B:
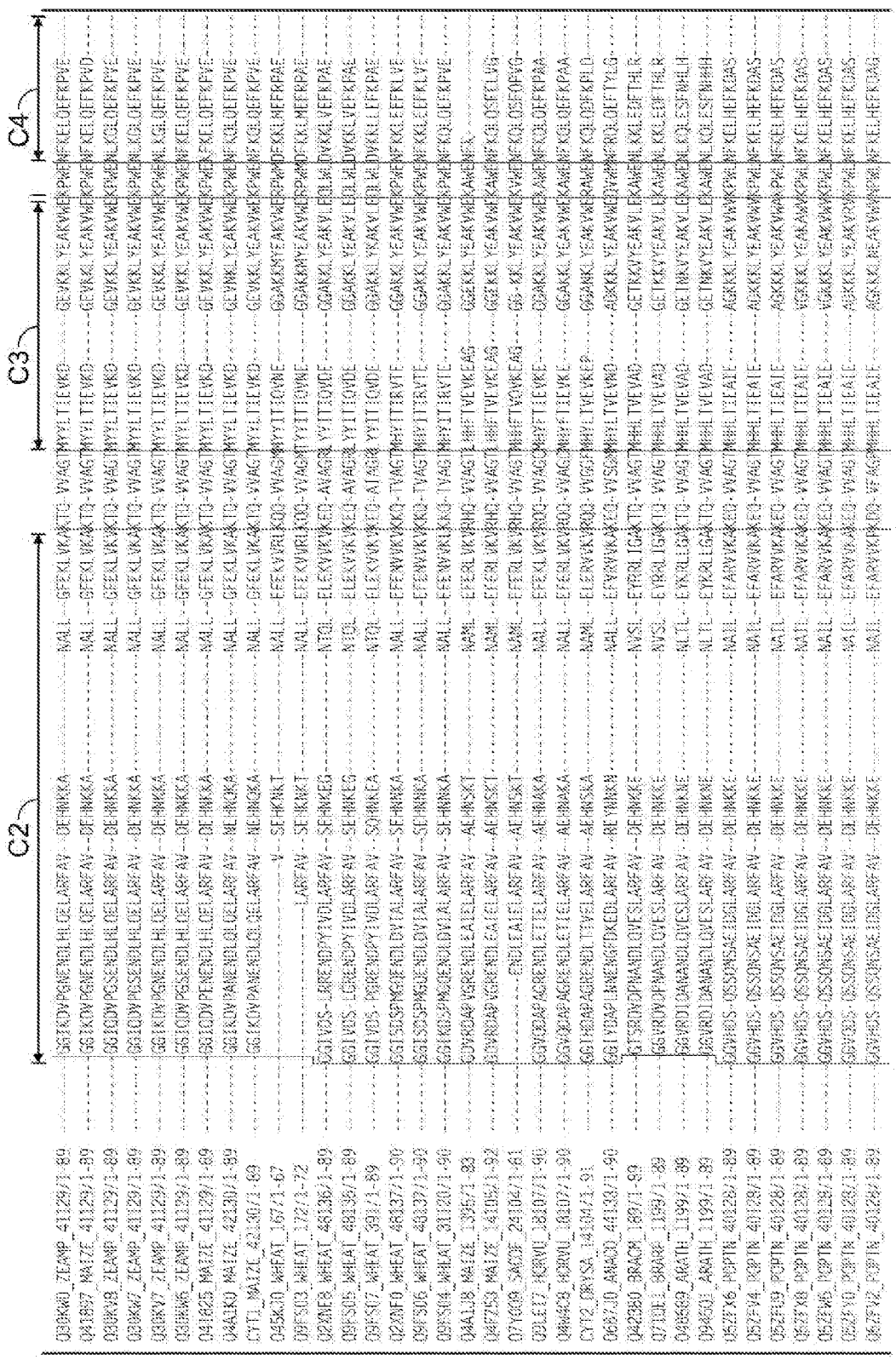
FIG. 2 is an alignment of the sequences of a number of proteins that have regions which can be used as a scaffold. These proteins are homologous to oryzacystatin. The C1, C2, C3 and C4 are boxed and labeled. The sequences shown are SEQ ID NO:132 (i.e., the conserved sequence among the nine homologous sequences of from Q2V816_CUCMA__1441/1-28 to Q2V814_CUCMO__734/1-28); SEQ ID NO:133 (i.e., Q2V8H9_LAGLE__431/1-28); SEQ ID NO:134 (i.e., the conserved sequence between the two homologous sequences of Q6DKU9_CUCMA__1441/1-28 and Q6DLC8_CUCMA__1441/1-28); SEQ ID NO:135 (i.e., 080389_CUCSA__795/1-89); SEQ ID NOs:136-150 (i.e., QIRVW3_MEDTR__2578/1-54 to Q8GZV2_CHEMJ__340/1-38); SEQ ID NO:130 (i.e., Reference/1-102); and SEQ ID NOs:151-198 and 200-330 (i.e., CYT1_ORYSA__1097/1-88 to end).

What is claimed is:

1. A library of cDNA encoding at least ten different polypeptides, the amino acid sequence of each polypeptide comprising:

$C_1$-$C_2$-$X_2$-$C_3$-$X_3$-$C_4$, wherein
(i) subsequence $C_1$ is selected from the $C_1$ sequences boxed and labeled in FIG. 2 and FIG. 4, subsequence $C_2$ is selected from the $C_2$ sequences boxed and labeled in FIG. 2 and FIG. 4, subsequence $C_3$ is selected from the $C_3$ sequences boxed and labeled in FIG. 2 and FIG. 4; subsequence $C_4$ is selected from the $C_4$ sequences boxed and labeled in FIG. 2 and FIG. 4;
(ii) $C_1$-$C_4$ are homogeneous across a plurality of the encoded polypeptides;
(iii) each of $X_1$-$X_3$ is an independently variable subsequence consisting of 2-20 amino acids; and
(iv) each of $X_1$-$X_3$ are heterogeneous across a plurality of the encoded polypeptides.

2. The library of claim 1, wherein said subsequences of $C_1$, $C_2$, $C_3$, and $C_4$ of said plurality of the encoded polypeptides are homologous to subsequences of $C_1$, $C_2$, $C_3$, and $C_4$ of oryzacystatin, said subsequences of $C_1$, $C_2$, $C_3$ and $C_4$ of said oryzacystatin having the amino acid sequence as set forth in SEQ ID NO:130 at positions 1-3, 8-50, 59-81, and 86-102, respectively.

3. A method of generating the library of claim 1, comprising;
(i) providing a parental nucleic acid encoding a parental polypeptide comprising the amino acid sequence: $C_1$-$X_1$-$C_2$-$X_2$-$C_3$-$X_3$-$C_4$, wherein subsequence $C_1$ is selected from the $C_1$ sequences boxed and labeled in FIG. 2 and FIG. 4, subsequence $C_2$ is selected from the $C_2$ sequences boxed and labeled in FIG. 2 and FIG. 4, subsequence $C_3$ is selected from the $C_3$ sequences boxed and labeled in FIG. 2 and FIG. 4; subsequence $C_4$ is selected from the $C_4$ sequences boxed and labeled in FIG. 2 and FIG. 4; each of $X_1$-$X_3$ is an independent subsequence consisting of 2-20 amino acid positions;
(ii) replicating the parental nucleic acid under conditions that introduce up to 10 single amino acid substitutions, deletions, insertions, or additions to the $X_1$, $X_2$, or $X_3$ subsequences, whereby a population of randomly varied subsequences encoding $X_1'$, $X_2'$, or $X_3'$ is generated; and
(iii) the population of randomly varied subsequences $X_1'$, $X_2'$, or $X_3'$ is substituted, into a population of parental nucleic acids at the positions corresponding to those that encode $X_1$, $X_2$, or $X_3$.

4. A method of generating the library of claim 1, comprising:
(i) selecting an amino acid sequence comprising $C_1$-$X_1$-$C_2$-$X_2$-$C_3$-$X_3$-$C_4$ to be encoded, wherein
(a) subsequence $C_1$ is selected from the $C_1$ sequences boxed and labeled in FIG. 2 and FIG. 4, subsequence $C_2$ is selected from the $C_2$ sequences boxed and labeled in FIG. 2 and FIG. 4, subsequence $C_3$ is selected from the $C_3$ sequences boxed and labeled in FIG. 2 and FIG. 4; subsequence $C_4$ is selected from the $C_4$ sequences boxed and labeled in FIG. 2 and FIG. 4;
(b) each of $X_1$, $X_2$, and $X_3$ consists of an amino acid sequence 2-20 amino acid positions in length;
(ii) providing a first plurality and a second plurality of oligonucleotides, wherein
(a) oligonucleotides of the first plurality encode the $C_1$-$C_4$ subsequences and multiple heterogeneous $X_1$-$X_3$ variant subsequences $X_1'$-$X_3'$;
(b) oligonucleotides of the second plurality are complementary to nucleotide sequences encoding the $C_1$-$C_4$ subsequences and to nucleotide sequences encoding multiple heterogeneous $X_1'$-$X_3'$ subsequences; and
(c) the oligonucleotides of the first and second pluralities have overlapping sequences complementary to one another;
(iii) combining the population of oligonucleotides to form a first mixture;
(iv) incubating the mixture under conditions effective for hybridizing the overlapping complementary sequences to form a plurality of hybridized complementary sequences; and
(v) elongating the plurality of hybridized complementary sequences to form a second mixture containing the library.

Figure 5:
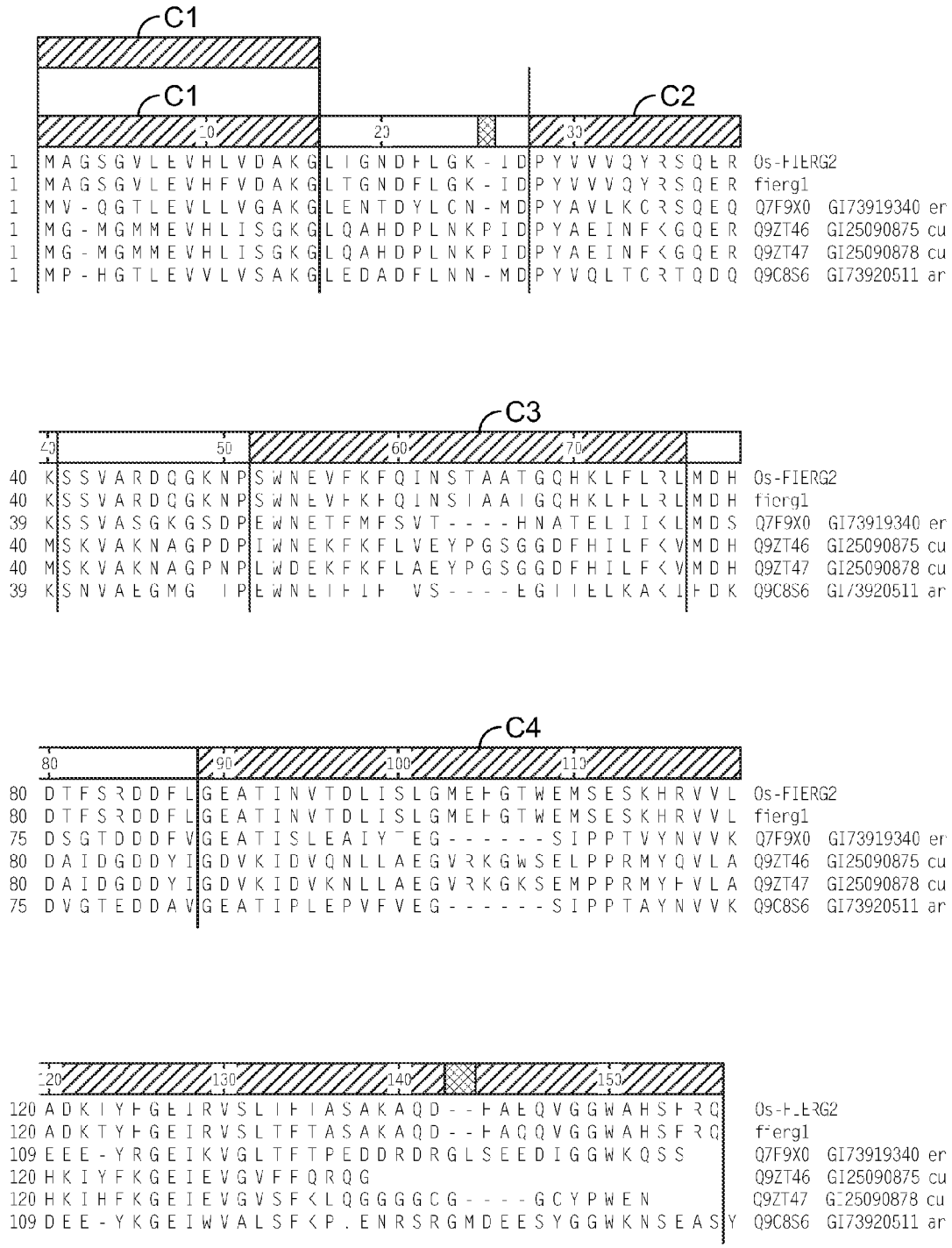
FIG. 5 is an alignment of the sequences of a number of proteins that have regions which can be used as a scaffold. The sequences shown are, from top to bottom, SEQ ID NO:131 and SEQ ID NOs:839-843. These proteins are homologous to C2. The C1, C2, C3 and C4 are boxed and labeled.

5. A library of cDNA encoding at least ten different polypeptides, the amino acid sequence of each polypeptide comprising:

$C_1$-$X_1$-$C_2$-$X_2$-$C_3$-$X_3$-$C_4$ wherein
(i) subsequence $C_1$ is selected from the $C_1$ sequences boxed and labeled in FIG. 3 and FIG. 5, subsequence $C_2$ is selected from the $C_2$ sequences boxed and labeled in FIG. 3 and FIG. 5, subsequence $C_3$ is selected from the $C_3$ sequences boxed and labeled in FIG. 3 and FIG. 5; subsequence $C_4$ is selected from the $C_4$ sequences boxed and labeled in FIG. 3 and FIG. 5;
(ii) $C_1$-$C_4$ are homogeneous across a plurality of the encoded polypeptides;
(iii) each of $X_1$-$X_3$ is an independently variable subsequence consisting of 2-20 amino acids; and
(iv) each of $X_1$-$X_3$ are heterogeneous across a plurality of the encoded polypeptides.

6. The library of claim 5, wherein said subsequences of $C_1$, $C_2$, $C_3$, and $C_4$ of said plurality of the encoded polypeptides are homologous to subsequences of $C_1$, $C_2$, $C_3$, and $C_4$ of C2 protein of rice, said subsequences of $C_1$, $C_2$, $C_3$ and $C_4$ of said C2 protein of rice having the amino acid sequence as set forth in SEQ ID NO:131 at positions 1-16, 28-40, 52-76, and 89-156, respectively.

7. A method of generating the library of claim 5, comprising:
(i) providing a parental nucleic acid encoding a parental polypeptide comprising the amino acid sequence: $C_1$-$X_1$-$C_2$-$X_2$-$C_3$-$X_3$-$C_4$, wherein subsequence $C_1$ is selected from the $C_1$ sequences boxed and labeled in FIG. 3 and FIG. 5, subsequence $C_2$ is selected from the $C_2$ sequences boxed and labeled in FIG. 3 and FIG. 5, subsequence $C_3$ is selected from the $C_3$ sequences boxed and labeled in FIG. 3 and FIG. 5; subsequence $C_4$ is selected from the $C_4$ sequences boxed and labeled in FIG. 3 and FIG. 5; each of $X_1$-$X_3$ is an independent subsequence consisting of 2-20 amino acid positions;
(ii) replicating the parental nucleic acid under conditions that introduce up to 10 single amino acid substitutions, deletions, insertions, or additions to the $X_1$, $X_2$, or $X_3$ subsequences, whereby a population of randomly varied subsequences encoding $X_1'$, $X_2'$, or $X_3'$ is generated; and
(iii) the population of randomly varied subsequences $X_1'$, $X_2'$, or $X_3'$ is substituted, into a population of parental nucleic acids at the positions corresponding to those that encode $X_1$, $X_2$, or $X_3$.

8. A method of generating the library of claim 5, comprising:
(i) selecting an amino acid sequence comprising: $C_1$-$X_1$-$C_2$-$X_2$-$C_3$-$X_3$-$C_4$ to be encoded, wherein
(a) subsequence $C_1$ is selected from the $C_1$ sequences boxed and labeled in FIG. 3 and FIG. 5, subsequence $C_2$ is selected from the $C_2$ sequences boxed and labeled in FIG. 3 and FIG. 5, subsequence $C_3$ is selected from the $C_3$ sequences boxed and labeled in FIG. 3 and FIG. 5; subsequence $C_4$ is selected from the $C_4$ sequences boxed and labeled in FIG. 3 and FIG. 5;

(b) each of $X_1$, $X_2$, and $X_3$ consists of an amino acid sequence 2-20 amino acid positions in length;

(ii) providing a first plurality and a second plurality of oligonucleotides, wherein (a) oligonucleotides of the first plurality encode the $C_1$-$C_4$ subsequences and multiple heterogeneous $X_1$-$X_3$ variant subsequences $X_1'$-$X_3'$;

(b) oligonucleotides of the second plurality are complementary to nucleotide sequences encoding the $C_1$-$C_4$ subsequences and to nucleotide sequences encoding multiple heterogeneous $X_1'$-$X_3'$ subsequences; and (c) the oligonucleotides of the first and second pluralities have overlapping sequences complementary to one another;

(iii) combining the population of oligonucleotides to form a first mixture;

(iv) incubating the mixture under conditions effective for hybridizing the overlapping complementary sequences to form a plurality of hybridized complementary sequences; and (v) elongating the plurality of hybridized complementary sequences to form a second mixture containing the library.

* * * * *